US007799530B2

(12) United States Patent
Iakoubova et al.

(10) Patent No.: US 7,799,530 B2
(45) Date of Patent: Sep. 21, 2010

(54) GENETIC POLYMORPHISMS ASSOCIATED WITH CARDIOVASCULAR DISORDERS AND DRUG RESPONSE, METHODS OF DETECTION AND USES THEREOF

(75) Inventors: Olga Iakoubova, San Ramon, CA (US); James Devlin, Lafayette, CA (US)

(73) Assignee: Celera Corporation, Alameda, CA (US)

( * ) Notice: Subject to any disclaimer, the term of this patent is extended or adjusted under 35 U.S.C. 154(b) by 448 days.

(21) Appl. No.: 11/526,137

(22) Filed: Sep. 22, 2006

(65) Prior Publication Data

US 2007/0072821 A1    Mar. 29, 2007

Related U.S. Application Data

(60) Provisional application No. 60/720,274, filed on Sep. 23, 2005.

(51) Int. Cl.
*C12Q 1/68* (2006.01)
*C07H 21/04* (2006.01)
*C12P 19/34* (2006.01)

(52) U.S. Cl. .......................... 435/6; 536/24.3; 435/91.2

(58) Field of Classification Search .................. None
See application file for complete search history.

(56) References Cited

U.S. PATENT DOCUMENTS

2004/0181048 A1 * 9/2004 Wang ........................ 536/24.3

FOREIGN PATENT DOCUMENTS

| WO | WO 0159160 A1 * | 8/2001 |
| WO | WO 2004/067779 A2 | 8/2004 |
| WO | 2005056837 A | 6/2005 |
| WO | WO 2005/083127 A2 | 9/2005 |
| WO | WO 2005/087953 A2 | 9/2005 |
| WO | 2008118415 A | 10/2008 |

OTHER PUBLICATIONS

Hirschhorn et al. (Genetics in Medicine. vol. 4, No. 2, pp. 45-61, Mar. 2002).*
Luo et al (Journal of Medical Genetics (2007) vol. 44, pp. 161-165.*
Hegele et al (Arteriosclerosis, Thrombosis, and Vascular Biology. 2002;22:1058-1061).*
Wall et al (Nature Reviews Genetics (2003) vol. 4, pp. 587-597).*
Tischkoff et al (Nature Genetics (2004) vol. 36, pp. s21-s27).*
Alexandre, F.R., et al., "Kinesin Family Member 6 Variant Trp719Arg Does Not Associate with Angiographically Defined Coronary Artery Disease in the Ottawa Heart Genomics Study," Journal of the American College of Cardiology, vol. 53, No. 16, Apr. 21, 2009, pp. 1471-1472.
Bare, L. A., et al., "Five Common Gene Variants Identity Elevated Genetic Risk for Coronary Heart Disease," Genetics in Medicine, vol. 9, No. 10, Oct. 2007, pp. 682-689.
Iakoubova, O. A., et al., "Association of the Trp719Arg Polymorphism in Kinesin-Like Protein 6 with Myocardial Infarction and Coronary Heart Disease in 2 Prospective Trials," Journal of The American College of Cariology, vol. 51, No. 4, 2008, pp. 435-443.
Iakoubova, O. A., et.al., "Polymorpisms in KIF6 Gene and Benefiit from Statins After Acute Coronary Syndromes," Journal of The American College of Cariology, vol. 51, No. 4, 2008, pp. 449-455.
Morrison, A. C., et al., "Prediction of Coronary Heart Disease Risk Using a Genetic Risk Score: The Atherosclerosis Risk in Communities Study," American Journal of Epidemiology, Apr. 18, 2007, pp. 1-8.
Shiffman, D., et al., "Association of Gene Variants with Myocardial Infarction in the Cardiovascular Health Study," Arteriosclerosis, Thrombosis and Vascular Biology, vol. 28, Dec. 19, 2007, pp. 173-179.
Shiffman, D., et al., "A Kinesin Family Member 6 Variant is Associated with Coronary Heart Disease in the Women's Health Study," Journal of The American College of Cardiology, vol. 51, No. 4, 2008, pp. 444-448.
Database NCBI SNP [Online] "Submitted SNP ss23899966; RefSNP rs20455" XP002550449 retrieved from NCBI, Database Accession No. ss23899966, Aug. 20, 2004.
Maitland-Van Der Zee, A., et al., "Pharmacogenetics of Response to Statins: Where Do We Stand?", Current Atherosclerosis Reports, Current Science, May 1, 2005, vol. 7, No. 3, pp. 204-208.
Marian, A., et al., "Surprises of the Genome and 'Personalized' Medicine", Journal of The American College of Cardiology, Jan. 22, 2008, vol. 51, No. 4, pp. 456-458.
Supplementary European Search Report issued for EP06815404.6, dated Oct. 28, 2009.

* cited by examiner

*Primary Examiner*—Steven C Pohnert

(57) ABSTRACT

The present invention is based on the discovery of genetic polymorphisms that are associated with cardiovascular disorders, particularly acute coronary events such as myocardial infarction and stroke, and genetic polymorphisms that are associated with responsiveness of an individual having a cardiovascular disorder to treatment of the disorder with statin. In particular, the present invention relates to nucleic acid molecules containing the polymorphisms, variant proteins encoded by such nucleic acid molecules, reagents for detecting the polymorphic nucleic acid molecules and proteins, and methods of using the nucleic acid and proteins as well as methods of using reagents for their detection.

39 Claims, 1 Drawing Sheet

GENETIC POLYMORPHISMS ASSOCIATED WITH CARDIOVASCULAR DISORDERS AND DRUG RESPONSE, METHODS OF DETECTION AND USES THEREOF

CROSS-REFERENCE TO RELATED APPLICATIONS

This application claims the benefit of U.S. provisional application Ser. No. 60/720,274, filed on Sep. 23, 2005, the contents of which are hereby incorporated by reference in its entirety into this application.

FIELD OF THE INVENTION

The present invention is in the field of cardiovascular disorders and drug response, particularly acute coronary events and statin treatment of acute coronary events. In particular, the present invention relates to specific single nucleotide polymorphisms (SNPs) in the human genome, and their association with acute coronary events and/or variability in responsiveness to statin treatment (including preventive treatment) between different individuals. The naturally occurring SNPs disclosed herein can be used as targets for the design of diagnostic reagents and the development of therapeutic agents, as well as for disease association and linkage analysis. In particular, the SNPs of the present invention are useful, for example, in identifying whether an individual is likely to experience an acute coronary event (either a first or recurrent acute coronary event), for predicting the seriousness or consequences of an acute coronary event in an individual, for determining the prognosis of an individual's recovery from an acute coronary event, for evaluating the likelihood of an individual's response of to statins for the treatment/prevention of acute coronary events, for providing clinically important information for the prevention and/or treatment of acute coronary events, and for screening and selecting therapeutic agents. The SNPs disclosed herein are also useful for human identification applications. Methods, assays, kits, and reagents for detecting the presence of these polymorphisms and their encoded products are provided.

BACKGROUND OF THE INVENTION

Acute Coronary Events and Response to Statin Treatment

The present invention relates to SNPs that are associated with the occurrence of cardiovascular disorders, particularly acute coronary events such as myocardial infarction and stroke. The present invention also relates to SNPs that are associated with variability between different individuals in the responses to treatment (including preventive treatments) of cardiovascular disorders with statins (e.g., pravastatin).

Myocardial Infarction

Myocardial infarction (MI) is the most common cause of mortality in developed countries. It is a multifactorial disease that involves atherogenesis, thrombus formation and propagation. Thrombosis can result in complete or partial occlusion of coronary arteries. The luminal narrowing or blockage of coronary arteries reduces oxygen and nutrient supply to the cardiac muscle (cardiac ischemia), leading to myocardial necrosis and/or stunning. MI, unstable angina, or sudden ischemic death are clinical manifestations of cardiac muscle damage. All three endpoints are part of the Acute Coronary Syndrome since the underlying mechanisms of acute complications of atherosclerosis are considered to be the same.

Atherogenesis, the first step of pathogenesis of MI, is a complex interaction between blood elements, mechanical forces, disturbed blood flow, and vessel wall abnormality. On the cellular level, these include endothelial dysfunction, monocytes/macrophages activation by modified lipoproteins, monocytes/macrophages migration into the neointima and subsequent migration and proliferation of vascular smooth muscle cells (VSMC) from the media that results in plaque accumulation.

In recent years, an unstable (vulnerable) plaque was recognized as an underlying cause of arterial thrombotic events and MI. A vulnerable plaque is a plaque, often not stenotic, that has a high likelihood of becoming disrupted or eroded, thus forming a thrombogenic focus. Two vulnerable plaque morphologies have been described. A first type of vulnerable plaque morphology is a rupture of the protective fibrous cap. It can occur in plaques that have distinct morphological features such as large and soft lipid pool with distinct necrotic core and thinning of the fibrous cap in the region of the plaque shoulders. Fibrous caps have considerable metabolic activity. The imbalance between matrix synthesis and matrix degradation thought to be regulated by inflammatory mediators combined with VSMC apoptosis are the key underlying mechanisms of plaque rupture. A second type of vulnerable plaque morphology, known as "plaque erosion", can also lead to a fatal coronary thrombotic event. Plaque erosion is morphologically different from plaque rupture. Eroded plaques do not have fractures in the plaque fibrous cap, only superficial erosion of the intima. The loss of endothelial cells can expose the thrombogenic subendothelial matrix that precipitates thrombus formation. This process could be regulated by inflammatory mediators. The propagation of the acute thrombi for both plaque rupture and plaque erosion events depends on the balance between coagulation and thrombolysis. MI due to a vulnerable plaque is a complex phenomenon that includes: plaque vulnerability, blood vulnerability (hypercoagulation, hypothrombolysis), and heart vulnerability (sensitivity of the heart to ischemia or propensity for arrhythmia).

Recurrent myocardial infarction (RMI) can generally be viewed as a severe form of MI progression caused by multiple vulnerable plaques that are able to undergo pre-rupture or a pre-erosive state, coupled with extreme blood coagulability.

The incidence of MI is still high despite currently available preventive measures and therapeutic intervention. More than 1,500,000 people in the US suffer acute MI each year (many without seeking help due to unrecognized MI), and one third of these people die. The lifetime risk of coronary artery disease events at age 40 years is 42.4% for men (one in two) and 24.9% for women (one in four) (Lloyd-Jones D M; *Lancet*, 1999 353: 89-92).

The current diagnosis of MI is based on the levels of troponin I or T that indicate the cardiac muscle progressive necrosis, impaired electrocardiogram (ECG), and detection of abnormal ventricular wall motion or angiographic data (the presence of acute thrombi). However, due to the asymptomatic nature of 25% of acute MIs (absence of atypical chest pain, low ECG sensitivity), a significant portion of MIs are not diagnosed and therefore not treated appropriately (e.g., prevention of recurrent MIs).

Despite a very high prevalence and lifetime risk of MI, there are no good prognostic markers that can identify an individual with a high risk of vulnerable plaques and justify preventive treatments. MI risk assessment and prognosis is currently done using classic risk factors or the recently introduced Framingham Risk Index. Both of these assessments put a significant weight on LDL levels to justify preventive treatment. However, it is well established that half of all MIs occur in individuals without overt hyperlipidemia. Hence, there is a need for additional risk factors for predicting predisposition to MI.

Other emerging risk factors are inflammatory biomarkers such as C-reactive protein (CRP), ICAM-1, SAA, TNF α, homocysteine, impaired fasting glucose, new lipid markers (ox LDL, Lp-a, MAD-LDL, etc.) and pro-thrombotic factors (fibrinogen, PAI-1). Despite showing some promise, these markers have significant limitations such as low specificity and low positive predictive value, and the need for multiple reference intervals to be used for different groups of people (e.g., males-females, smokers-non smokers, hormone replacement therapy users, different age groups). These limitations diminish the utility of such markers as independent prognostic markers for MI screening.

Genetics plays an important role in MI risk. Families with a positive family history of MI account for 14% of the general population, 72% of premature MIs, and 48% of all MIs (R R Williams, *Am J Cardiology*, 2001; 87:129). In addition, replicated linkage studies have revealed evidence of multiple regions of the genome that are associated with MI and relevant to MI genetic traits, including regions on chromosomes 14, 2, 3 and 7 (Broeckel U, *Nature Genetics*, 2002; 30: 210; Harrap S, *Arterioscler Thromb Vasc Biol*, 2002; 22: 874-878, Shearman A, *Human Molecular Genetics*, 2000, 9; 9,1315-1320), implying that genetic risk factors influence the onset, manifestation, and progression of MI. Recent association studies have identified allelic variants that are associated with acute complications of coronary heart disease, including allelic variants of the ApoE, ApoA5, Lpa, APOCIII, and Klotho genes.

Genetic markers such as single nucleotide polymorphisms are preferable to other types of biomarkers. Genetic markers that are prognostic for MI can be genotyped early in life and could predict individual response to various risk factors. The combination of serum protein levels and genetic predisposition revealed by genetic analysis of susceptibility genes can provide an integrated assessment of the interaction between genotypes and environmental factors, resulting in synergistically increased prognostic value of diagnostic tests.

Thus, there is an urgent need for novel genetic markers that are predictive of predisposition to MI, particularly for individuals who are unrecognized as having a predisposition to MI. Such genetic markers may enable prognosis of MI in much larger populations compared with the populations that can currently be evaluated by using existing risk factors and biomarkers. The availability of a genetic test may allow, for example, appropriate preventive treatments for acute coronary events to be provided for susceptible individuals (such preventive treatments may include, for example, statin treatments and statin dose escalation, as well as changes to modifiable risk factors), lowering of the thresholds for ECG and angiography testing, and allow adequate monitoring of informative biomarkers.

Moreover, the discovery of genetic markers associated with MI will provide novel targets for therapeutic intervention or preventive treatments of MI, and enable the development of new therapeutic agents for treating MI and other cardiovascular disorders.

Stroke

Stroke is a prevalent and serious disease. Stroke is the most common cause of disability, the second leading cause of dementia, and the third leading cause of mortality in the United States. It affects 4.7 million individuals in the United States, with 500,000 first attacks and 200,000 recurrent cases yearly. Approximately one in four men and one in five women aged 45 years will have a stroke if they live to their 85th year. About 25 percent of those who have a stroke die within a year. For that, stroke is the third leading cause of mortality in the United States and is responsible for 170,000 deaths a year. Among those who survive the stroke attack, 30 to 50 percent do not regain functional independence. Stroke therefore is the most common cause of disability and the second leading cause of dementia.

Stroke occurs when an artery bringing oxygen or nutrients to the brain either ruptures, causing the hemorrhagic type of strokes, or gets occluded, causing the thrombotic/embolic strokes that are collectively referred to as ischemic strokes. In each case, a cascade of cellular changes due to ischemia or increased cranial pressure leads to injuries or death of the brain cells. In the United States, the majority (about 80-90%) of strokes are ischemic, including 31% large-vessel thrombotic (also referred to as large-vessel occlusive disease), 20% small-vessel thrombotic (also referred to as small-vessel occlusive disease), and 32% embolic or cardiogenic (caused by a clot originating from elsewhere in the body, e.g., from blood pooling due to atrial fibrillation, or from carotid artery stenosis). The ischemic form of stroke shares common pathological etiology with atherosclerosis and thrombosis. Approximately 10-20% of strokes are of the hemorrhagic type, involving bleeding within or around the brain. Bleeding within the brain is known as cerebral hemorrhage, which is often linked to high blood pressure. Bleeding into the meninges surrounding the brain is known as a subarachnoid hemorrhage, which could be caused by a ruptured cerebral aneurysm, an arteriovenous malformation, or a head injury. The hemorrhagic strokes, although less prevalent, pose a greater danger. Whereas about 8 percent of ischemic strokes result in death within 30 days, about 38 percent of hemorrhagic strokes result in death within the same time period.

Known risk factors for stroke can be divided into modifiable and non-modifiable risk factors. Older age, male sex, black or Hispanic ethnicity, and family history of stroke are non-modifiable risk factors. Modifiable risk factors include hypertension, smoking, increased insulin levels, asymptomatic carotid disease, cardiac vessel disease, and hyperlipidemia. Information derived from the Dutch Twin Registry estimates the heritability of stroke as 0.32 for stroke death and 0.17 for stroke hospitalization.

The acute nature of stroke leaves physicians with little time to prevent or lessen the devastation of brain damage. Strategies to diminish the impact of stroke include prevention and treatment with thrombolytic and, possibly, neuroprotective agents. The success of preventive measures will depend on the identification of risk factors and means to modulate their impact.

Although some risk factors for stroke are not modifiable, such as age and family history, other underlying pathology or risk factors of stroke such as atherosclerosis, hypertension, smoking, diabetes, aneurysm, and atrial fibrillation, are chronic and amenable to effective life-style, medical, and surgical treatments. Early recognition of patients with these risk factors, and especially those with a family history, with a non-invasive test of genetic markers will enable physicians to target the highest risk individuals for aggressive risk reduction.

Statin Treatment

Coronary heart disease (CHD) accounts for approximately two-thirds of cardiovascular mortality in the United States, with CHD accounting for 1 in every 5 deaths in 1998, which makes it the largest single cause of morality (*American Heart Association.* 2001 *Heart and Stroke Statistical Update. Dallas, Tex.: American Heart Association.* 2000). Stroke is the third leading cause of death, accounting for 1 of every 15 deaths. Reduction of coronary and cerebrovascular events and total mortality by treatment with HMG-CoA reductase inhibitors (statins) has been demonstrated in a number of randomized, double blinded, placebo controlled prospective trials (Waters, D. D., *What do the statin trials tell us?* Clin Cardiol, 2001. 24(8 Suppl): p. III3-7, Singh, B. K. and J. L. Mehta, *Management of dyslipidemia in the primary prevention of coronary heart disease.* Curr Opin Cardiol, 2002. 17(5): p. 503-11). These drugs have their primary effect through the inhibition of hepatic cholesterol synthesis, thereby upregulating LDL receptor in the liver. The resultant increase in LDL catabolism results in decreased circulating LDL, a major risk factor for cardiovascular disease. In addition, statins cause relatively small reductions in triglyceride levels (5 to 10%) and elevations in HDL cholesterol (5 to 10%). In a 5 year primary intervention trial (WOSCOPS), pravastatin decreased clinical events 29% compared to placebo in hypercholesterolemic subjects, achieving a 26% reduction in LDL-cholesterol (LDL-C) (Shepherd, J., et al., *Prevention of coronary heart disease with pravastatin in men with hypercholesterolemia. West of Scotland Coronary Prevention Study Group.* N Engl J Med, 1995. 333(20): p. 1301-7). In a similar primary prevention trial (AFCAPS/TexCAPS) (Downs, J. R., et al., *Primary prevention of acute coronary events with lovastatin in men and women with average cholesterol levels: results of AFCAPS/TexCAPS. Air Force/Texas Coronary Atherosclerosis Prevention Study.* Jama, 1998. 279 (20): p. 1615-22) in which subjects with average cholesterol levels were treated with lovastatin, LDL-C was reduced an average of 25% and events decreased by 37%. Secondary prevention statin trials include the CARE (Sacks, F. M., et al., *The effect of pravastatin on coronary events after myocardial infarction in patients with average cholesterol levels. Cholesterol and Recurrent Events Trial investigators.* N Engl J Med, 1996. 335(14): p. 1001-9) and LIPID (treatment with pravastatin) (*Prevention of cardiovascular events and death with pravastatin in patients with coronary heart disease and a broad range of initial cholesterol levels. The Long-Term Intervention with pravastatin in Ischaemic Disease (LIPID) Study Group.* N Engl J Med, 1998. 339(19): p. 1349-57), and 4S (treatment with simvastatin) (*Randomised trial of cholesterol lowering in 4444 patients with coronary heart disease: the Scandinavian Simvastatin Survival Study (4S).* Lancet, 1994. 344(8934): p. 1383-9) studies. In these trials, clinical event risk was reduced from between 23% and 34% with achieved LDL-C lowering ranging between 25% and 35%.

In addition to LDL-lowering, a variety of potential non-lipid lowering effects have been suggested to play a role in cardiovascular risk reduction by statins. These include anti-inflammatory effects on various vascular cell types including foam cell macrophages, improved endothelial responses, inhibition of platelet reactivity thereby decreasing hypercoaguability, and many others (Puddu, P., G. M. Puddu, and A. Muscari, *Current thinking in statin therapy.* Acta Cardiol, 2001. 56(4): p. 225-31, Albert, M. A., et al., *Effect of statin therapy on C-reactive protein levels: the pravastatin inflammation/CRP evaluation (PRINCE): a randomized trial and cohort study.* Jama, 2001. 286(1): p. 64-70, Rosenson, R. S., *Non-lipid-lowering effects of statins on atherosclerosis.* Curr Cardiol Rep, 1999. 1(3): p. 225-32, Dangas, G., et al., *pravastatin: an antithrombotic effect independent of the cholesterol-lowering effect.* Thromb Haemost, 2000. 83(5): p. 688-92, Crisby, M., *Modulation of the inflammatory process by statins.* Drugs Today (Barc), 2003. 39(2): p. 137-43, Liao, J. K., *Role of statin pleiotropism in acute coronary syndromes and stroke.* Int J Clin Pract Suppl, 2003(134): p. 51-7). However, because hypercholesterolemia is a factor in many of these additional pathophysiologic mechanisms that are reversed by statins, many of these statin benefits may be a consequence of LDL lowering.

Statins as a class of drug are generally well tolerated. The most common side effects include a variety of muscle-related complaints or myopathies. While the incidence of muscle side effects are low, the most serious side effect, myositis with rhabdomyolysis, is life threatening. This adverse effect has been highlighted by the recent withdrawal of cerevastatin when the drug was found to be associated with a relatively high level of rhabdomyolysis-related deaths. In addition, the development of a high dose sustained release formulation of simvastatin was discontinued for rhabdomyolysis-related issues (Davidson, M. H., et al., *The efficacy and six-week tolerability of simvastatin 80 and 160 mg/day.* Am J Cardiol, 1997. 79(1): p. 38-42).

Statins can be divided into two types according to their physicochemical and pharmacokinetic properties. Statins such as lovastatin, simvastatin, atorvastatin, and cerevastatin are hydrophobic in nature and, as such, diffuse across membranes and thus are highly cell permeable.

Hydrophilic statins such as pravastatin are more polar, such that they require specific cell surface transporters for cellular uptake (Ziegler, K. and W. Stunkel, *Tissue-selective action of pravastatin due to hepatocellular uptake via a sodium-independent bile acid transporter.* Biochim Biophys Acta, 1992. 1139(3): p. 203-9, Yamazaki, M., et al., *Na(+)-independent multispecific anion transporter mediates active transport of pravastatin into rat liver.* Am J Physiol, 1993. 264(1 Pt 1): p. G36-44, Komai, T., et al., *Carrier-mediated uptake of pravastatin by rat hepatocytes in primary culture.* Biochem Pharmacol, 1992. 43(4): p. 667-70). The latter statin utilizes a transporter, OATP2, whose tissue distribution is confined to the liver and, therefore, they are relatively hepato-specific inhibitors (Hsiang, B., et al., *A novel human hepatic organic anion transporting polypeptide (OATP2). Identification of a liver-specific human organic anion transporting polypeptide and identification of rat and human hydroxymethylglutaryl-CoA reductase inhibitor transporters.* J Biol Chem, 1999. 274(52): p. 37161-8). The former statins, not requiring specific transport mechanisms, are available to all cells and they can directly impact a much broader spectrum of cells and tissues. These differences in properties may influence the spectrum of activities that each statin possesses. pravastatin, for instance, has a low myopathic potential in animal models and myocyte cultures compared to other hydrophobic statins (Masters, B. A., et al., *In vitro myotoxicity of the 3-hydroxy-3-methylglutaryl coenzyme A reductase inhibitors, pravastatin, lovastatin, and simvastatin, using neonatal rat skeletal myocytes.* Toxicol Appl Pharmacol, 1995. 131(1): p. 163-74. Nakahara, K., et al., *Myopathy induced by HMG-CoA reductase inhibitors in rabbits: a pathological, electrophysiological, and biochemical study.* Toxicol Appl Pharmacol, 1998. 152(1): p. 99-106, Reijneveld, J. C., et al., *Differential effects of 3-hydroxy-3-methylglutaryl-coenzyme A reductase inhibitors on the development of myopathy in young rats.* Pediatr Res, 1996. 39(6): p. 1028-35).

Cardiovascular mortality in developed countries has decreased sharply in recent decades (Tunstall-Pedoe, H., et al., *Estimation of contribution of changes in coronary care to improving survival, event rates, and coronary heart disease mortality across the WHO MONICA Project populations.* Lancet, 2000. 355(9205): p. 688-700). This is likely due to the development and use of efficaceous hypertension, thrombolytic and lipid lowering therapies (Kuulasmaa, K., et al., *Estimation of contribution of changes in classic riskfactors to trends in coronary-event rates across the WHO MONICA*

*Project populations*. Lancet, 2000. 355(9205): p. 675-87). Nevertheless, cardiovascular diseases remain the major cause of death in industrialized countries, at least in part due to the presence of highly prevalent risk factors and insufficient treatment (Wong, M. D., et al., *Contribution of major diseases to disparities in mortality*. N Engl J Med, 2002. 347(20): p. 158-92). Even with appropriate therapy, not all patients respond equally well to statin treatment. Despite the overwhelming evidence that statins decrease risk for cardiovascular disease, both in primary and secondary intervention settings, statin therapy clearly only achieves partial risk reduction. While a decrease in risk of 23 to 37% seen in the above trials is substantial and extremely important clinically, the majority of events still are not prevented by statin treatment. This is not surprising given the complexity of cardiovascular disease etiology, which is influenced by genetics, environment, and a variety of additional risk factors including dyslipidemia, age, gender, hypertension, diabetes, obesity, and smoking. It is reasonable to assume that all of these multi-factorial risks modify statin responses and determine the final benefit that each individual achieves from therapy. Furthermore, with the increasing incidence of Type 2 diabetes and obesity in Western countries (Flegal, K. M., et al., *Prevalence and trends in obesity among US adults*, 1999-2000. Jama, 2002. 288(14): p. 1723-7, Boyle, J. P., et al., *Projection of diabetes burden through* 2050: *impact of changing demography and disease prevalence in the US*. Diabetes Care, 2001. 24(11): p. 1936-40), which are two major risk factors for coronary artery disease, and the emergence of greater cardiovascular risk factors in the developing world (Yusuf, S., et al., *Global burden of cardiovascular diseases: Part II: variations in cardiovascular disease by specific ethnic groups and geographic regions and prevention strategies*. Circulation, 2001. 104(23): p. 2855-64, Yusuf, S., et al., *Global burden of cardiovascular diseases: part I: general considerations, the epidemiologic transition, risk factors, and impact of urbanization*. Circulation, 2001. 104(22): p. 2746-53), the need for ever more effective treatment of CHD is predicted to steadily increase.

Thus, there is a growing need for ways to better identify people who have the highest chance to benefit from statins, and those who have the lowest risk of developing side-effects. As indicated above, severe myopathies represent a significant risk for a low percentage of the patient population. This would be particularly true for patients that may be treated more aggressively with statins in the future. There are currently at least three studies in progress that are investigating whether treatments aimed at lowering LDL-C to levels below current NCEP goals by administering higher statin doses to patients further reduces CHD risk or provides additional cardiovascular benefits (reviewed in Clark, L. T., *Treating dyslipidemia with statins: the risk-benefit profile*. Am Heart J, 2003. 145 (3): p. 387-96). It is possible that more aggressive statin therapy than is currently standard practice will become the norm in the future if additional benefit is observed in such trials. More aggressive statin therapy will likely increase the incidence of the above adverse events as well as elevate the cost of treatment. Thus, increased emphasis will be placed on stratifying responder and non-responder patients in order for maximum benefit-risk ratios to be achieved at the lowest cost.

The Third Report of the Expert Panel on Detection, Evaluation and Treatment of High Blood Cholesterol in Adults (ATPIII) contains current recommendations for the management of high serum cholesterol (*Executive Summary of The Third Report of The National Cholesterol Education Program (NCEP) Expert Panel on Detection, Evaluation, And Treatment of High Blood Cholesterol In Adults (Adult Treatment Panel III)*. Jama, 2001. 285(19): p. 2486-97). A meta-analysis of 38 primary and secondary prevention trials found that for every 10% decrease in serum cholesterol, CHD mortality was reduced by 15%. These guidelines took into account additional risk factors beyond serum cholesterol when making recommendations for lipid lowering strategies. After considering additional risk factors and updated information on lipid lowering clinical trials, more patients are classified in the highest risk category of CHD or CHD risk equivalent than before and are recommended to decrease their LDL to less than 100 mg/dl. As a consequence, more aggressive therapy is recommended and drug therapy is recommended for 36.5 million Americans. In implementing these recommendations, cost-effectiveness of treatments is a primary concern. In lower risk populations, the cost of reducing one event may exceed $125,000 compared with around $25,000 per event in a high-risk patient group (Singh, B. K. and J. L. Mehta, *Management of dyslipidemia in the primary prevention of coronary heart disease*. Curr Opin Cardiol, 2002. 17(5): p. 503-11). The cost of preventing an event in a very low risk patient may exceed $1 million. In the context of cost-containment, further risk stratification of patients will help to avoid unnecessary treatment of patients. In addition to the various clinical endpoints that are currently considered in determining overall risk, the determination of who and who not to treat with statins based on "statin response" genotypes could substantially increase the precision of these determinations in the future.

Evidence from gene association studies is accumulating to indicate that responses to drugs are, indeed, at least partly under genetic control. As such, pharmacogenetics—the study of variability in drug responses attributed to hereditary factors in different populations—may significantly assist in providing answers toward meeting this challenge (Roses, A. D., *Pharmacogenetics and the practice of medicine*. Nature, 2000. 405(6788): p. 857-65, Mooser, V., et al., *Cardiovascular pharmacogenetics in the SNP era*. J Thromb Haemost, 2003. 1(7): p. 1398-1402, Humma, L. M. and S. G. Terra, *Pharmacogenetics and cardiovascular disease: impact on drug response and applications to disease management*. Am. J. Health Syst Pharm, 2002. 59(13): p. 1241-52). Numerous associations have been reported between selected genotypes, as defined by SNPs and other sequence variations and specific responses to cardiovascular drugs. Polymorphisms in several genes have been suggested to influence responses to statins including CETP (Kuivenhoven, J. A., et al., *The role of a common variant of the cholesteryl ester transfer protein gene in the progression of coronary atherosclerosis. The Regression Growth Evaluation Statin Study Group*. N Engl J Med, 1998. 338(2): p. 86-93), beta-fibrinogen (de Maat, M. P., et al., *–455G/A polymorphism of the beta-fibrinogen gene is associated with the progression of coronary atherosclerosis in symptomatic men: proposed role for an acute-phase reaction pattern of fibrinogen. REGRESS group*. Arterioscler Thromb Vasc Biol, 1998. 18(2): p. 265-71), hepatic lipase (Zambon, A., et al., *Common hepatic lipase gene promoter variant determines clinical response to intensive lipid-lowering treatment*. Circulation, 2001. 103(6): p. 792-8, lipoprotein lipase (Jukema, J. W., et al., *The Asp9 Asn mutation in the lipoprotein lipase gene is associated with increased progression of coronary atherosclerosis. REGRESS Study Group, Interuniversity Cardiology Institute, Utrecht, The Netherlands. Regression Growth Evaluation Statin Study*. Circulation, 1996. 94(8): p. 1913-8), glycoprotein IIIa (Bray, P. F., et al., *The platelet Pl(A2) and angiotensin-converting enzyme (ACE) D allele polymorphisms and the risk of recurrent events after acute myocardial infarction*. Am J Cardiol, 2001.

88(4): p. 347-52), stromelysin-1 (de Maat, M. P., et al., *Effect of the stromelysin-1promoter on efficacy of pravastatin in coronary atherosclerosis and restenosis*. Am J Cardiol, 1999. 83(6): p. 852-6), and apolipoprotein E (Gerdes, L. U., et al., *The apolipoprotein epsilon4 allele determines prognosis and the effect on prognosis of simvastatin in survivors of myocardial infarction: a substudy of the Scandinavian simvastatin survival study*. Circulation, 2000. 101(12): p. 1366-71, Pedro-Botet, J., et al., *Apolipoprotein E genotype affects plasma lipid response to atorvastatin in a gender specific manner*. Atherosclerosis, 2001. 158(1): p. 183-93). Some of these variants were shown to effect clinical events while others were associated with changes in surrogate endpoints. The CETP variant alleles B1 and B2 were shown to be correlated with HDL cholesterol levels. Patients with B1B1 and B1B2 genotypes have lower HDL cholesterol and greater progression of angiographically-determined atherosclerosis than B2B2 subjects when on placebo during the pravastatin REGRESS clinical trial. Furthermore, B1B1 and B1B2 had significantly less progression of atherosclerosis when on pravastatin whereas B2B2 patients derived no benefit. Similarly, beta-fibrinogen promoter sequence variants were also associated with disease progression and response to pravastatin in the same study as were Stomelysin-1 promoter variants. In the Cholesterol and Recurrent Events (CARE) trial, a pravastatin secondary intervention study, glycoprotein IIIa variants were also associated with clinical event response to pravastatin. In all of the above cases, genetic subgroups of placebo-treated patients with CHD were identified who had increased risk for major coronary events. Treatment with pravastatin abolished the harmful effects associated with the "riskier" genotype, while having little effect on patients with genotypes that were associated with less risk. Finally, the impact of the apolipoprotein $\epsilon 4$ genotype on prognosis and the response to simvastatin or placebo was investigated in the Scandanavian Simvastatin Survival Study (Pedro-Botet, J., et al., *Apolipoprotein E genotype affects plasma lipid response to atorvastatin in a gender specific manner*. Atherosclerosis, 2001. 158(1): p. 183-93). Patients with at least one apolipoprotein $\epsilon 4$ allele had a higher risk for all cause death than those lacking the allele. As was the case with pravastatin treatment, simvastatin reversed this detrimental effect of the "riskier allele". These results suggest that, in general, high-risk patients with ischemic heart disease derive the greatest benefit from statin therapy. However, these initial observations should be repeated in other cohorts to further support the predictive value of these specific genotypes. Although it is likely that additional genes beyond the five examples above impact the final outcome of an individual's response to statins, these five examples serve to illustrate that it is possible to identify genes that associate with statin clinical responses that could be used to predict which patients will benefit from statin treatment and which will not.

SNPs

The genomes of all organisms undergo spontaneous mutation in the course of their continuing evolution, generating variant forms of progenitor genetic sequences (Gusella, *Ann. Rev. Biochem.* 55, 831-854 (1986)). A variant form may confer an evolutionary advantage or disadvantage relative to a progenitor form or may be neutral. In some instances, a variant form confers an evolutionary advantage to the species and is eventually incorporated into the DNA of many or most members of the species and effectively becomes the progenitor form. Additionally, the effects of a variant form may be both beneficial and detrimental, depending on the circumstances. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence gives rise to genetic polymorphisms, including SNPs.

Approximately 90% of all polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker, or marker) is usually preceded by and followed by highly conserved sequences of the allele (e.g., sequences that vary in less than 1/100 or 1/1000 members of the populations). An individual may be homozygous or heterozygous for an allele at. each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel" (Weber et al., "Human diallelic insertion/deletion polymorphisms", *Am J Hum Genet* 2002 October;71(4):854-62).

A synonymous codon change, or silent mutation/SNP (terms such as "SNP," "polymorphism," "mutation," "mutant," "variation" and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of the SNPs are bi-allelic, and are thus often referred to as "bi-allelic markers" or "di-allelic markers."

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases (Stephens et al. Science 293, 489-493, 20 Jul. 2001).

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence. In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as those individuals who respond to statin treatment ("responders") or those individuals who do not respond to statin treatment ("non-responders"), and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific phenotype, such as such as response or non-response to statin treatment of cardiovascular disease. Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. (Linder et al. (1997), *Clinical Chemistry*, 43, 254; Marshall (1997), *Nature Biotechnology*, 15, 1249; International Patent Application WO 97/40462, Spectra Biomedical; and Schafer et al. (1998), *Nature Biotechnology*, 16, 3).

SUMMARY OF THE INVENTION

The present invention relates to the identification of novel SNPs, unique combinations of such SNPs, and haplotypes of SNPs that are associated with cardiovascular disorders and/or drug response, particularly acute coronary events (e.g., myocardial infarction) and response to statins for the treatment (including preventive treatment) of cardiovascular disorders such as acute coronary events. The polymorphisms disclosed herein are directly useful as targets for the design of diagnostic reagents and the development of therapeutic agents for use in the diagnosis and treatment of cardiovascular disorders and related pathologies, particularly acute coronary events.

Based on the identification of SNPs associated with cardiovascular disorders, particular acute coronary events, and/or response to statin treatment, the present invention also provides methods of detecting these variants as well as the design and preparation of detection reagents needed to accomplish this task. The invention specifically provides, for example, novel SNPs in genetic sequences involved in cardiovascular disorders and/or responsiveness to statin treatment, isolated nucleic acid molecules (including, for example, DNA and RNA molecules) containing these SNPs, variant proteins encoded by nucleic acid molecules containing such SNPs, antibodies to the encoded variant proteins, computer-based and data storage systems containing the novel SNP information, methods of detecting these SNPs in a test sample, methods of determining the risk of an individual of experiencing a first or recurring acute coronary event, methods for prognosing the severity or consequences of the acute coronary event, methods of treating an individual who has an increased risk of experiencing an acute coronary event, methods of identifying individuals who have an altered (i.e., increased or decreased) likelihood of responding to statin treatment of a cardiovascular disorder (e.g., an acute coronary event) based on the presence or absence of one or more particular nucleotides (alleles) at one or more SNP sites disclosed herein or the detection of one or more encoded variant products (e.g., variant mRNA transcripts or variant proteins), methods of identifying individuals who are more or less likely to respond to a treatment, particularly statin treatment of a cardiovascular disorder such as an acute coronary event (or more or less likely to experience undesirable side effects from a treatment, etc.), methods of screening for compounds useful in the treatment of a disorder associated with a variant gene/protein, compounds identified by these methods, methods of treating disorders mediated by a variant gene/protein, methods of using the novel SNPs of the present invention for human identification, etc. The present invention also provides methods for identifying individuals who possess SNPs that are associated with an increased risk of developing an acute coronary event such as MI, and yet can benefit from being treated with statin because statin treatment can lower their risk of developing an acute coronary event such as MI.

Since cardiovascular disorders/diseases share certain similar features that may be due to common genetic factors that are involved in their underlying mechanisms, the SNPs identified herein as being particularly associated with acute coronary events and/or statin response may be used as diagnostic/prognostic markers or therapeutic targets for a broad spectrum of cardiovascular diseases such as coronary heart disease (CHD), atherosclerosis, cerebrovascular disease, congestive heart failure, congenital heart disease, and pathologies and symptoms associated with various heart diseases (e.g., angina, hypertension), as well as for predicting responses to drugs other than statins that are used to treat cardiovascular diseases.

The present invention further provides methods for selecting or formulating a treatment regimen (e.g., methods for determining whether or not to administer statin treatment to an individual having cardiovascular disease, methods for selecting a particular statin-based treatment regimen such as dosage and frequency of administration of statin, or a particular form/type of statin such as a particular pharmaceutical formulation or compound, methods for administering an alternative, non-statin-based treatment to individuals who are predicted to be unlikely to respond positively to statin treatment, etc.), and methods for determining the likelihood of experiencing toxicity or other undesirable side effects from statin treatment, etc. The present invention also provides methods for selecting individuals to whom a statin or other therapeutic will be administered based on the individual's genotype, and methods for selecting individuals for a clinical trial of a statin or other therapeutic agent based on the genotypes of the individuals (e.g., selecting individuals to participate in the trial who are most likely to respond positively from the statin treatment). The present invention further provides methods for reducing the risk of an individual in developing cardiovascular disorders such as MI or RMI, using statin treatment, when said individual carries one or more SNPs identified herein as being associated with such cardiovascular disorders.

In Tables 1-2, the present invention provides gene information, transcript sequences (SEQ ID NOS:1-60), encoded amino acid sequences (SEQ ID NOS:61-120), genomic sequences (SEQ ID NOS:201-250), transcript-based context sequences (SEQ ID NOS: 121-200) and genomic-based context sequences (SEQ ID NOS:251-410) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The transcript sequences (SEQ ID NOS:1-60), amino acid sequences (SEQ ID NOS:61-120), genomic sequences (SEQ ID NOS:201-250), transcript-based SNP context sequences (SEQ ID NOS:121-200), and genomic-based SNP context sequences (SEQ ID NOS:251-410) are also provided in the Sequence Listing.

In a specific embodiment of the present invention, SNPs that occur naturally in the human genome are provided as isolated nucleic acid molecules. These SNPs are associated with cardiovascular disorders, particular acute coronary events, and/or response to statin treatment, such that they can have a variety of uses in the diagnosis and/or treatment of cardiovascular disorders and related pathologies and particularly in the treatment of cardiovascular disorders with statins. One aspect of the present invention relates to an isolated nucleic acid molecule comprising a nucleotide sequence in which at least one nucleotide is a SNP disclosed in Tables 3 and/or 4. In an alternative embodiment, a nucleic acid of the invention is an amplified polynucleotide, which is produced by amplification of a SNP-containing nucleic acid template. In another embodiment, the invention provides for a variant protein which is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein that is encoded by a nucleic acid molecule containing a SNP disclosed herein. A preferred embodiment of a protein detection reagent is an antibody or an antigen-reactive antibody fragment.

Various embodiments of the invention also provide kits comprising SNP detection reagents, and methods for detecting the SNPs disclosed herein by employing detection reagents. In a specific embodiment, the present invention provides for a method of identifying an individual having an increased or decreased risk of developing a cardiovascular disorder (e.g. experiencing an acute coronary event) by detecting the presence or absence of one or more SNP alleles disclosed herein. The present invention also provides methods for evaluating whether an individual is likely (or unlikely) to respond to statin treatment of cardiovascular disease by detecting the presence or absence of one or more SNP alleles disclosed herein.

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment of cardiovascular diseases.

An aspect of this invention is a method for treating cardiovascular disorders, particular acute coronary events, in a human subject wherein said human subject harbors a SNP, gene, transcript, and/or encoded protein identified in Tables 1-2, which method comprises administering to said human subject a therapeutically or prophylactically effective amount of one or more agents (e.g. statins) counteracting the effects of the disorder, such as by inhibiting (or stimulating) the activity of the gene, transcript, and/or encoded protein identified in Tables 1-2.

Another aspect of this invention is a method for identifying an agent useful in therapeutically or prophylactically treating cardiovascular disorders, particular acute coronary events, in a human subject wherein said human subject harbors a SNP, gene, transcript, and/or encoded protein identified in Tables 1-2, which method comprises contacting the gene, transcript, or encoded protein with a candidate agent (e.g., statin) under conditions suitable to allow formation of a binding complex between the gene, transcript, or encoded protein and the candidate agent (such as a statin) and detecting the formation of the binding complex, wherein the presence of the complex identifies said agent.

Another aspect of this invention is a method for treating a cardiovascular disorder in a human subject, which method comprises:

(i) determining that said human subject harbors a SNP, gene, transcript, and/or encoded protein identified in Tables 1-2, and (ii) administering to said subject a therapeutically or prophylactically effective amount of one or more agents (such as a statin) counteracting the effects of the disease.

Many other uses and advantages of the present invention will be apparent to those skilled in the art upon review of the detailed description of the preferred embodiments herein. Solely for clarity of discussion, the invention is described in the sections below by way of non-limiting examples.

Description of the Files Contained on the CD-R Named CD000002ORD CDR

The CD-R named CD000002ORD CDR contains the following five text (ASCII) files:

1) File SEQLIST_CD000002ORD.txt provides the Sequence Listing. The Sequence Listing provides the transcript sequences (SEQ ID NOS:1-60) and protein sequences (SEQ ID NOS:61-120) as shown in Table 1, and genomic sequences (SEQ ID NOS:201-250) as shown in Table 2, for each gene that contains one or more SNPs of the present invention. Also provided in the Sequence Listing are context sequences flanking each SNP, including both transcript-based context sequences as shown in Table 1 (SEQ ID NOS:121-200) and genomic-based context sequences as shown in Table 2 (SEQ ID NOS:251-410). The context sequences generally provide 100 bp upstream (5') and 100 bp downstream (3') of each SNP, with the SNP in the middle of the context sequence, for a total of 200 bp of context sequence surrounding each SNP. File SEQLIST_CD000002ORD.txt is 1,451 KB in size, and was created on Sep. 21, 2006.

2) File TABLE1_CD000002ORD.txt provides Table 1. File TABLE1_CD000002ORD.txt is 96 KB in size, and was created on Sep. 21, 2006.

3) File TABLE2_CD000002ORD.txt provides Table 2. File TABLE2_CD000002ORD.txt is 122 KB in size, and was created on Sep. 21, 2006.

4) File TABLE3_CD000002ORD.txt provides Table 3. File TABLE3_CD000002ORD.txt is 1 KB in size, and was created on Sep. 21, 2006.

5) File TABLE4_CD000002ORD.txt provides Table 4. File TABLE4_CD00002ORD.txt is 1 KB in size, and was created on Sep. 21, 2006. The material contained on the CD-R labeled CD000002ORDCDR is hereby incorporated by reference pursuant to 37 CFR 1.77(b)(4).

LENGTHY TABLES

The patent contains a lengthy table section. A copy of the table is available in electronic form from the USPTO web site (http://seqdata.uspto.gov/?pageRequest=docDetail&DocID=US07799530B2). An electronic copy of the table will also be available from the USPTO upon request and payment of the fee set forth in 37 CFR 1.19(b)(3).

Description of Table 1 and Table 2

Table 1 and Table 2 (both provided on the CD-R) disclose the SNPs and associated gene/transcript/protein information of the present invention. For each gene, Table 1 and Table 2 each provide a header containing gene/transcript/protein information, followed by a transcript and protein sequence (in Table 1) or genomic sequence (in Table 2), and then SNP information regarding each SNP found in that gene/transcript.

NOTE: SNPs may be included in both Table 1 and Table 2; Table 1 presents the SNPs relative to their transcript sequences and encoded protein sequences, whereas Table 2 presents the SNPs relative to their genomic sequences (in some instances Table 2 may also include, after the last gene sequence, genomic sequences of one or more intergenic regions, as well as SNP context sequences and other SNP information for any SNPs that lie within these intergenic regions). SNPs can readily be cross-referenced between Tables based on their hCV (or, in some instances, hDV) identification numbers.

The gene/transcript/protein information includes:

a gene number (1 through n, where n=the total number of genes in the Table)

a Celera hCG and UID internal identification numbers for the gene a Celera hCT and UID internal identification numbers for the transcript (Table 1 only)

a public Genbank accession number (e.g., RefSeq NM number) for the transcript (Table 1 only)

a Celera hCP and UID internal identification numbers for the protein encoded by the hCT transcript (Table 1 only)

a public Genbank accession number (e.g., RefSeq NP number) for the protein (Table 1 only)

an art-known gene symbol an art-known gene/protein name

Celera genomic axis position (indicating start nucleotide position-stop nucleotide position)

the number of the chromosome on which the gene is located an OMIM (Online Mendelian Inheritance in Man; Johns Hopkins University/NCBI) public reference number for obtaining further information regarding the medical significance of each gene alternative gene/protein name(s) and/or symbol(s) in the OMIM entry.

NOTE: Due to the presence of alternative splice forms, multiple transcript/protein entries can be provided for a single gene entry in Table 1; i.e., for a single Gene Number, multiple entries may be provided in series that differ in their transcript/protein information and sequences.

Following the gene/transcript/protein information is a transcript sequence and protein sequence (in Table 1), or a genomic sequence (in Table 2), for each gene, as follows:

transcript sequence (Table 1 only) (corresponding to SEQ ID NOS:1-60 of the Sequence Listing), with SNPs identified by their IUB codes (transcript sequences can include 5' UTR, protein coding, and 3' UTR regions)

NOTE: If there are differences between the nucleotide sequence of the hCT transcript and the corresponding public transcript sequence identified by the Genbank accession number, the hCT transcript sequence (and encoded protein) is provided, unless the public sequence is a RefSeq transcript sequence identified by an NM number, in which case the RefSeq NM transcript sequence (and encoded protein) is provided. However, whether the hCT transcript or RefSeq NM transcript is used as the transcript sequence, the disclosed SNPs are represented by their IUB codes within the transcript.

the encoded protein sequence (Table 1 only; corresponding to SEQ ID NOS:61-120 of the Sequence Listing)

the genomic sequence of the gene (Table 2 only), including 6 kb on each side of the gene boundaries (i.e., 6 kb on the 5' side of the gene plus 6 kb on the 3' side of the gene; corresponding to SEQ ID NOS:201-250 of the Sequence Listing).

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (and such SNPs are identified as "INTERGENIC" for SNP type).

NOTE: The transcript, protein, and transcript-based SNP context sequences are provided in both Table 1 and in the Sequence Listing. The genomic and genomic-based SNP context sequences are provided in both Table 2 and in the Sequence Listing. SEQ ID NOS are indicated in Table 1 for each transcript sequence (SEQ ID NOS:1-60), protein sequence (SEQ ID NOS:61-120), and transcript-based SNP context sequence (SEQ ID NOS:121-200), and SEQ ID NOS are indicated in Table 2 for each genomic sequence (SEQ ID NOS:201-250), and genomic-based SNP context sequence (SEQ ID NOS:251-410).

The SNP information includes:

context sequence (taken from the transcript sequence in Table 1, and the genomic sequence in Table 2) with the SNP represented by its IUB code, including 100 base pairs upstream (5') of the SNP position plus 100 base pairs downstream (3') of the SNP position (the transcript-based SNP context sequences in Table 1 are provided in the Sequence Listing as SEQ ID NOS:121-200; the genomic-based SNP context sequences in Table 2 are provided in the Sequence Listing as SEQ ID NOS:251-410)

Celera hCV internal identification number for the SNP (in some instances, an "hDV" number is given instead of an "hCV" number)

SNP position (position of the SNP within the given transcript sequence [Table 1] or within the given genomic sequence [Table 2])

SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have cardiovascular disorders [e.g., experienced an acute coronary event], and/or have undergone statin treatment, "dbSNP"=SNP observed in the dbSNP public database, "HGBASE"=SNP observed in the HGBASE public database, "HGMD"=SNP observed in the Human Gene Mutation Database [HGMD] public database, "HapMap"=SNP observed in the International HapMap Project public database, "CSNP"=SNP observed in an internal Applied Biosystems [Foster City, Calif.] database of coding SNPS [cSNPs])

NOTE: Multiple "Applera" source entries for a single SNP indicate that the same SNP was covered by multiple overlapping amplification products and the re-sequencing results (e.g., observed allele counts) from each of these amplification products is being provided.

population/allele/allele count information in the format of [population 1 (first_allele count|second_allele,count) population2(first_allele,count|second_allele,count) total (first_allele,total count|second_allele,total count)]

NOTE: The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain"="American Indian, "cra"=Celera donor, "no_pop"=no population information available), identified SNP alleles, and observed allele counts (within each population group and total allele counts), where available ("-" in the allele field represents a deletion allele of an insertion/deletion ["indel" ] polymorphism, in which case the corresponding insertion allele, which may be comprised of one or more nucleotides, is indicated in the allele field on the opposite side of the "|"; "-" in the count field indicates that allele count information is not available).

NOTE: For SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

NOTE: Semicolons separate population/allele/count information corresponding to each indicated SNP source; i.e., if four SNP sources are indicated, such as "Celera", "dbSNP", "HGBASE", and "HGMD", then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information.

SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5" =SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary]

protein coding information (Table 1 only) where relevant, in the format of [protein SEQ ID NO:#, amino acid position, (amino acid-1, codon1) (amino acid-2, codon2)]

NOTE: The information in this field includes the SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Description of Table 3 and Table 4

Tables 3 and 4 (both provided on the CD-R) provide a list of a subset of SNPs from Table 1 (in the case of Table 3) or Table 2 (in the case of Table 4) for which the SNP source falls into one of the following three categories: 1) SNPs for which the SNP source is only "Applera" and none other, 2) SNPs for which the SNP source is only "Celera Diagnostics" and none other, and 3) SNPs for which the SNP source is both "Applera" and "Celera Diagnostics" but none other.

These SNPs have not been observed in any of the public databases (dbSNP, HGBASE, and HGMD), and were also not observed during shotgun sequencing and assembly of the Celera human genome sequence (i.e., "Celera" SNP source). Tables 3 and 4 provide the hCV identification number (or hDV identification number for SNPs having "Celera Diagnostics" SNP source) and the SEQ ID NO of the context sequence for each of these SNPs.

Description of Tables 5-21

Tables 5-21 provide the allelic frequencies and results of statistical analyses for SNPs disclosed in Tables 1-4 (SNPs can be cross-referenced between tables based on their hCV identification numbers). The results shown in Tables 5-21 provide support for the association of these SNPs with cardiovascular disorders, particularly acute coronary events such as myocardial infarction/recurrent MI, and/or the association of these SNPs with drug response, such as statins administered as a preventive treatment for acute coronary events. As one example, the statistical results in Tables 5-21 show that the association of these SNPs with risk of MI/RMI and/or response to statin treatment in the prevention of MI is supported by P values <0.05 in genotypic association tests.

Tables 5-10, 17 and 18 present statistics from the analysis of the genetic polymorphism hCV3054799 in gene c6orf102. Table 5 lists the number of case and control samples genotyped in the CARE and WOSCOPS studies, and the number of patients in each treatment arm, placebo and pravastatin. Also shown in this table are the frequencies of the major and minor alleles (i.e., higher and lower frequency alleles, respectively). Table 6 shows the genotypic frequencies for hCV3054799 in the CARE and WOSCOPS studies, while Table 7 lists the number of cases and controls of combined genotypes (major homozygous plus heterozygous, minor homozgyous plus heterozygous) that are used in calculating dominant and recessive modes of association with MI risk.

The association of SNP hCV3054799 with MI risk and response to statin treatment was evaluated using the allelic/genotypic frequencies from the counts obtained in Tables 5-7. Table 8 presents statistical data for the association of hCV3054799 with MI risk, in two replicated studies (in the case of the CARE study patients, recurrent MI specifically). Because this SNP is also associated with a positive response to statin treatment (see Table10), statistics in Table 8 are presented for patients stratified by treatment group (placebo vs. pravastatin), as well as for all patients unstratified. The risk estimates in Table 8 are not adjusted for conventional MI risk factors such as age, sex, and smoking/non-smoking status.

Table 9 presents the MI risk estimates for placebo-treated individuals that are heterozygous or homozygous for the rare (minor) allele of SNP hCV3054799. Odds ratios for the minor homozygous patients (Min hom) are derived from a comparison of the risk estimate for minor with major homozygote carriers; odds ratios for the heterozygous (Het) are derived from a comparison of the risk estimate for heterozygote with major homozygote carriers. In the CARE patients, risk estimates are justified by a stepwise logistic regression analysis, which serves to adjust for conventional risk factors such as age, sex, smoking/non-smoking status, and baseline LDL and HDL. In the WOSCOPS patients, logistic regression was done to adjust for baseline LDL and HDL. No adjustment was done for the sex stratum in WOSCOPS because all patients were male; likewise, no adjustment was done for smoking status or age, because cases and controls in WOSCOPS were matched for these parameters. This adjustment confirms the association of hCV3054799 with MI risk, independent of conventional risk factors.

Table 10 presents the statistical association of hCV3054799 with prevention of MI by statin treatment (i.e., response to pravastatin as an MI-preventive treatment) in two replicated studies. (In the CARE study, association of statins with prevention of recurrent MI is presented.) Also shown are the risk estimates of this SNP for MI/RMI in the placebo-treated patient group (data also shown in Table 8).

Comparing Tables 8-10 shows that this c6orf102 SNP is associated with MI risk AND response to statin treatment. Individuals in the placebo groups in both the CARE and WOSCOPS studies, who were heterozygous or homozygous for the minor allele, had a significantly higher risk of experiencing an MI than individuals who were homozygous for the major allele. Importantly, these statistics indicate that CARE individuals who were heterozygous or minor-allele homozygous were also significantly protected by pravastatin treatment against an adverse coronary event, relative to those individuals homozygous for the major allele. Tables 17 and 18 provide further analysis showing the association of hCV3054799 with MI risk and its association with prevention of MI by statin treatment. Tables 11-13 provide genotypic counts for other significant polymorphisms identified in the CARE study, by treatment arm. Tables 14 and 15 demonstrate the statistical associations of these SNPs with RMI risk, in placebo-treated patients (Table 14) and in all patients, unstratified by treatment arm (Table 15).

Table 16 shows significant markers from the CARE study and the statistical associations of their genotypes with RMI prevention by means of statin treatment (i.e., response to pravastatin as an MI-preventive treatment). Results are justified as a significant risk difference between placebo- and statin-treated groups, where the Breslow Day P values are <0.05 for each SNP. Tables 19 and 20 provide additional analysis showing that individuals carrying the markers listed in tables 19 and 20 can have their risk of developing MI/RMI reduced by statin treatment, given that those markers are MI/RMI-associated markers as shown in Table 14. There are six markers in table 20.

Table 21 provides a list of the sample LD SNPs that are related to and derived from an interrogated SNP. These LD SNPs are provided as an example of the groups of SNPs which can also serve as markers for disease association based on their being in LD with the interrogated SNP. The criteria and process of selecting such LD SNPs, including the calculation of the $r^2$ value and the $r^2$ threshold value, are described in Example 3, below.

In Table 21, the column labeled "Interrogated SNP" presents each marker as identified by its unique identifier, the hCV number. The column labeled "Interrogated SNP rs" presents the publicly known identifier rs number for the corresponding hCV number. The column labeled "LD SNP" presents the hCV numbers of the LD SNPs that are derived from their corresponding interrogated SNPs. The column labeled "LD SNP rs" presents the publicly known rs number for the corresponding hCV number. The column labeled "Power" presents the level of power where the $r^2$ threshold is set. For example, when power is set at 51%, the threshold $r^2$ value calculated therefrom is the minimum $r^2$ that an LD SNP must have in reference to an interrogated SNP, in order for the LD SNP to be classified as a marker capable of being associated with a disease phenotype at greater than 51% probability. The column labeled "Threshold $r_T^2$" presents the minimum value of $r^2$ that an LD SNP must meet in reference to an interrogated SNP in order to qualify as an LD SNP. The column labeled "$r^2$" presents the actual $r^2$ value of the LD SNP in reference to the interrogated SNP to which it is related.

NOTE: SNPs can be cross-referenced between Tables 1-21 based on the identification number (hCV number) provided for each SNP.

Follows are descriptions of the column headings used in the various Tables presented herein.

| TABLES 5-9 | |
|---|---|
| Column Heading | Definition |
| Study | CARE = Cholesterol and Recurrent Events. |
| | WOSCOPS = West of Scotland Coronary Prevention Study. |
| Stratum | Subpopulation used for analysis (placebo- or pravastatin-treated, or all patients, unstratified by treatment). |
| All Count, Case Count, Cont Count | Number of individuals analyzed in each study, separated into Case and Control groups according to MI status, or ALL samples combined. |
| Allele | Particular SNP variant investigated. |
| Case Freq, Cont Freq | Total number of chromosomes with each allele in each study, divided by twice the total number of individuals tested (i.e., two alleles per individual) for Cases or Controls. |
| Major Allele | Major = high frequency allele. |
| Minor Allele | Minor = rare (low frequency) allele. |
| Genot | Diploid genotypes present for this SNP. |
| Major homozygous | Carriers of 0 rare alleles. |
| Minor homozygous | Carriers of 2 rare alleles. |
| Heterozygous | Carriers of 1 rare allele. |
| Maj hom + Het | All carriers of 0 or 1 rare allele. |
| Het + Min hom | All carriers of 1 or 2 rare alleles. |
| Heterozygous Carriers (Het vs. Maj hom) OR | Odds ratio of an MI event for a carrier with 1 rare allele, using carriers with 0 rare alleles as a reference. ("95% CI" is the confidence interval.) |
| Dominant ([Het + Min hom] vs. Maj hom) OR | Odds ratio of an MI event for a carrier with 1 or 2 rare alleles, using carriers with 0 rare alleles as a reference. ("95% CI" is the confidence interval.) |
| Recessive (Min hom vs. [Maj hom + Het]) OR | OR of an MI event for a carrier with 2 rare alleles, using carriers with 0 rare alleles as a reference. ("95% CI" is the confidence interval.) |
| Allelic OR | Odds ratio of an MI event in those patients with genotypes possessing the rare allele vs. patients with no rare allele. |

| TABLE 10 | |
|---|---|
| Column Heading | Description |
| MI/RMI risk estimation (Het vs. Maj hom) OR | Odds ratio of an MI event with a genotype containing one rare allele vs. odds of MI in a genotype with no rare alleles. (Data from placebo-treated patients only.) |
| Risk Reduction by Statin (Heterozygous carriers) OR | Odds ratio of an MI event in pravastatin-treated vs. placebo-treated patients. (Data from heterozygous carriers only.) |

| TABLES 11-21 | |
|---|---|
| Column Heading | See Descriptions in previous tables and the Examples |

DETAILED DESCRIPTION OF THE INVENTION

Figure 1:
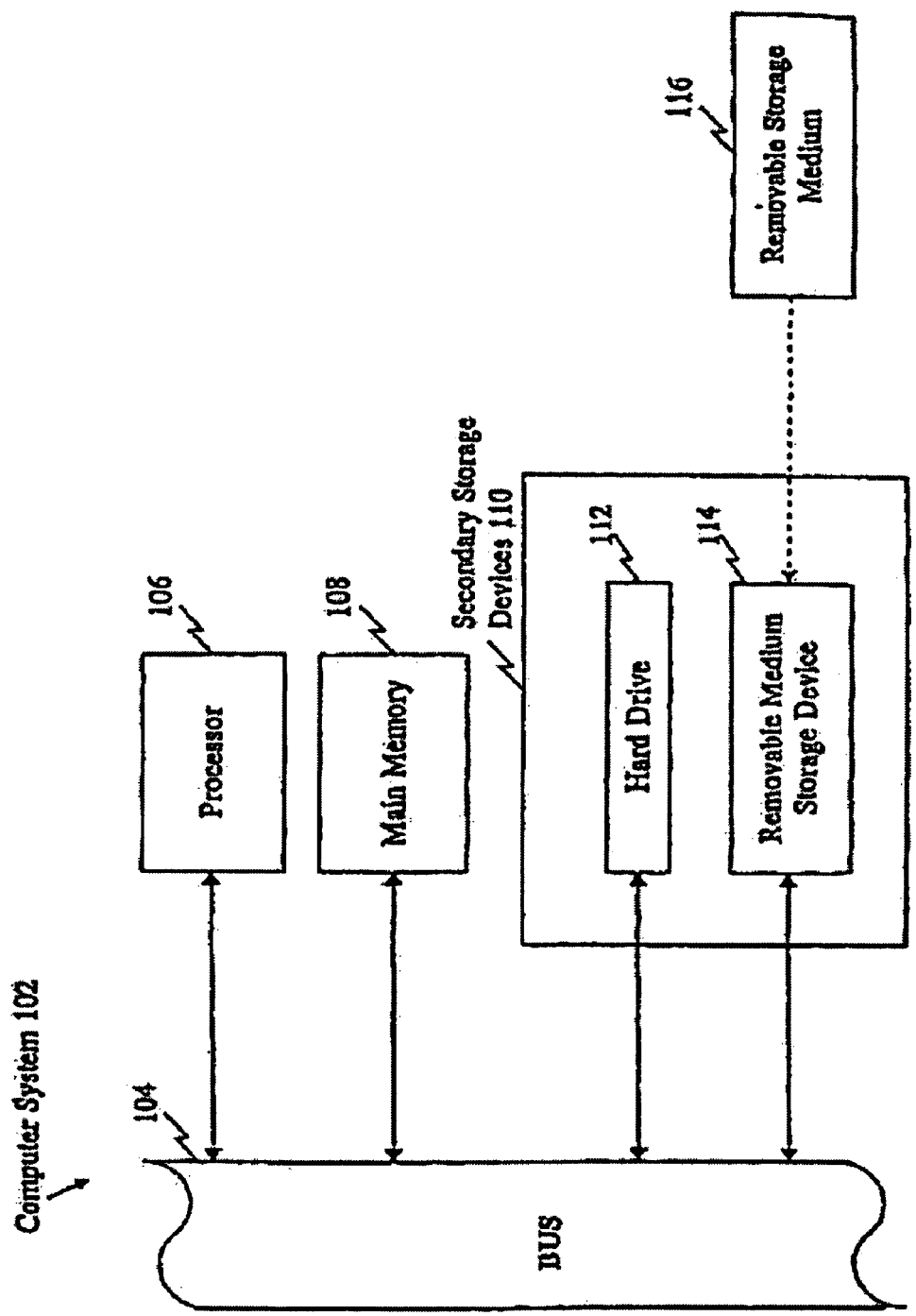
FIG. 1 provides a diagrammatic representation of a computer-based discovery system containing the SNP information of the present invention in computer readable form.

The present invention provides SNPs associated with cardiovascular disorders, particularly acute coronary events such as myocardial infarction and stroke (including recurrent acute coronary events such as recurrent myocardial infarction), and SNPs that are associated with an individual's responsiveness to therapeutic agents, particularly statins, that are used for the treatment (including preventive treatment) of cardiovascular disorders, particularly treatment of acute coronary events.

The present invention further provides nucleic acid molecules containing these SNPs, methods and reagents for the detection of the SNPs disclosed herein, uses of these SNPs for the development of detection reagents, and assays or kits that utilize such reagents. The statin response-associated SNPs disclosed herein are useful for diagnosing, screening for, and evaluating response to statin treatment of cardiovascular diseases in humans. Furthermore, such SNPs and their encoded products are useful targets for the development of therapeutic agents.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during shotgun sequencing and assembly of the human genome, and they are indicated as "Celera" SNP source in Tables 1-2. Furthermore, the information provided in Table 1-2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with cardiovascular disorders, particularly acute coronary events, and SNPs associated with responsiveness to statin for the treatment of cardiovascular diseases, as well as combinations of SNPs and haplotypes in genetic regions associated with cardiovascular disorders and/or statin response, polymorphic/variant transcript sequences (SEQ ID NOS:1-60) and genomic sequences (SEQ ID NOS:201-250) containing SNPs, encoded amino acid sequences (SEQ ID NOS: 61-120), and both transcript-based SNP context sequences (SEQ ID NOS: 121-200) and genomic-based SNP context sequences (SEQ ID NOS:251-410) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having or developing a cardiovascular disorder such as an acute coronary event, methods of determining response to statin treatment of cardiovascular disease, methods of screening for compounds useful for treating cardiovascular disease, compounds identified by these screening methods, methods of using the disclosed SNPs to select a treatment strategy, methods of treating a disorder associated with a variant gene/protein (i.e., therapeutic methods), and methods of using the SNPs of the present invention for human identification.

Since cardiovascular disorders/diseases share certain similar features that may be due to common genetic factors that are involved in their underlying mechanisms, the SNPs identified herein as being particularly associated with acute coronary events and/or statin response may be used as diagnostic/prognostic markers or therapeutic targets for a broad spectrum of cardiovascular diseases such as coronary heart disease (CHD), atherosclerosis, cerebrovascular disease, congestive heart failure, congenital heart disease, and pathologies and symptoms associated with various heart diseases (e.g., angina, hypertension), as well as for predicting responses to drugs other than statins that are used to treat cardiovascular diseases.

The present invention further provides methods for selecting or formulating a treatment regimen (e.g., methods for determining whether or not to administer statin treatment to an individual having cardiovascular disease, methods for selecting a particular statin-based treatment regimen such as dosage and frequency of administration of statin, or a particular form/type of statin such as a particular pharmaceutical formulation or compound, methods for administering an alternative, non-statin-based treatment to individuals who are predicted to be unlikely to respond positively to statin treatment, etc.), and methods for determining the likelihood of experiencing toxicity or other undesirable side effects from statin treatment, etc. The present invention also provides methods for selecting individuals to whom a statin or other therapeutic will be administered based on the individual's genotype, and methods for selecting individuals for a clinical trial of a statin or other therapeutic agent based on the genotypes of the individuals (e.g., selecting individuals to participate in the trial who are most likely to respond positively from the statin treatment).

The present invention provides novel SNPs associated with cardiovascular disorders and/or response to statin treatment, as well as SNPs that were previously known in the art, but were not previously known to be associated with cardiovascular disorders and/or statin response. Accordingly, the present invention provides novel compositions and methods based on the novel SNPs disclosed herein, and also provides novel methods of using the known, but previously unassociated, SNPs in methods relating to evaluating an individual's likelihood of having or developing a cardiovascular disorder, predicting the likelihood of an individual experiencing a reoccurrence of a cardiovascular disorder (e.g., experiencing recurrent myocardial infarctions) prognosing the severity of a cardiovascular disorder in an individual, or prognosing an individual's recovery from a cardiovascular disorder, and methods relating to evaluating an individual's likelihood of responding to statin treatment for cardiovascular disease. In Tables 1-2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD). Novel SNPs for which the SNP source is only "Applera" and none other, i.e., those that have not been observed in any public databases and which were also not observed during shotgun sequencing and assembly of the Celera human genome sequence (i.e., "Celera" SNP source), are indicated in Tables 3-4.

Particular SNP alleles of the present invention can be associated with either an increased risk of having a cardiovascular disorder (e.g., experiencing an acute coronary event) or of responding to statin treatment of cardiovascular disease, or a decreased likelihood of having a cardiovascular disorder or of responding to statin treatment of cardiovascular disease. Thus, whereas certain SNPs (or their encoded products) can be assayed to determine whether an individual possesses a SNP allele that is indicative of an increased likelihood of experiencing a coronary event or of responding to statin treatment, other SNPs (or their encoded products) can be assayed to determine whether an individual possesses a SNP allele that is indicative of a decreased likelihood of experiencing a coronary event or of responding to statin treatment. Similarly, particular SNP alleles of the present invention can be associated with either an increased or decreased likelihood of having a reoccurrence of a cardiovascular disorder, of fully recovering from a cardiovascular disorder, of experiencing toxic effects from a particular treatment or therapeutic compound, etc. The term "altered" may be used herein to encompass either of these two possibilities (e.g., an increased or a decreased risk/likelihood). SNP alleles that are associated with a decreased risk of having or developing a cardiovascular disorder such as myocardial infarction may be referred to as "protective" alleles, and SNP alleles that are associated with an increased risk of having or developing a cardiovascular disorder may be referred to as "susceptibility" alleles, "risk" alleles, or "risk factors".

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type", "reference", or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation, i.e. a SNP that creates a premature stop codon, a SNP that generates a read-through mutation by abolishing a stop codon, or due to any SNP disclosed by the present invention that otherwise alters the structure, function/activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide", "peptide", and "protein" are used interchangeably.

Isolated Nucleic Acid Molecules and SNP Detention Reagents & Kits

Tables 1 and 2 provide a variety of information about each SNP of the present invention that is associated with cardiovascular disorders (e.g., acute coronary events such as myocardial infarction and stroke) and/or responsiveness to statin treatment, including the transcript sequences (SEQ ID NOS: 1-60), genomic sequences (SEQ ID NOS:201-250), and protein sequences (SEQ ID NOS:61-120) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS:121-200 correspond to transcript-based SNP context sequences disclosed in Table 1, and SEQ ID NOS:251-410 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Preferred isolated nucleic acid molecules contain one or more SNPs identified in Table 3 and/or Table 4. Isolated nucleic acid molecules containing one or more SNPs disclosed in at least one of Tables 1-4 may be interchangeably referred to throughout the present text as "SNP-containing nucleic acid molecules". Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated." Nucleic acid molecules present in non-human transgenic animals, which do not naturally occur in the animal, are also considered "isolated". For example, recombinant DNA molecules contained in a vector are considered "isolated". Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances, the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are provided in Table 1 and in the Sequence Listing (SEQ ID NOS: 1-60), and polymorphic genomic sequences are provided in Table 2 and in the Sequence Listing (SEQ ID NOS:201-250). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences provided in Tables 1-2 (transcript sequences are provided in Table 1 as SEQ ID NOS:1-60, genomic sequences are provided in Table 2 as SEQ ID NOS: 201-250, transcript-based SNP context sequences are provided in Table 1 as SEQ ID NO:121-200, and genomic-based SNP context sequences are provided in Table 2 as SEQ ID NO:251-410) and their complements. A fragment typically comprises a contiguous nucleotide sequence at least about 8 or more nucleotides, more preferably at least about 12 or more nucleotides, and even more preferably at least about 16 or more nucleotides. Further, a fragment could comprise at least about 18, 20, 22, 25, 30, 40, 50, 60, 80, 100, 150, 200, 250 or 500 (or any other number in-between) nucleotides in length. The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195; and 4,683,202; *PCR Technology: Principles and Applications for DNA Amplification*, ed. H. A. Erlich, Freeman Press, NY, N.Y., 1992), ligase chain reaction (LCR) (Wu and Wallace, *Genomics* 4:560, 1989; Landegren et al., *Science* 241:1077, 1988), strand displacement amplification (SDA) (U.S. Pat. Nos. 5,270,184; and 5,422,252), transcription-mediated amplification (TMA) (U.S. Pat. No. 5,399,491), linked linear amplification (LLA) (U.S. Pat. No. 6,027,923), and the like, and isothermal amplification methods such as nucleic acid sequence based amplification (NASBA), and self-sustained sequence replication (Guatelli et al., *Proc. Natl. Acad. Sci. USA* 87: 1874, 1990). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1-2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product (however, as indicated above, the SNP of interest may be located anywhere along the length of the amplified product).

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are provided in Table 1 as SEQ ID NOS:1-60, genomic sequences are provided in Table 2 as SEQ ID NOS:201-250, transcript-based SNP context sequences are provided in Table 1 as SEQ ID NO:121-200, and genomic-based SNP context sequences are provided in Table 2 as SEQ ID NO:251-410), or any nucleic acid molecule that encodes any of the variant proteins provided in Table 1 (SEQ ID NOS:61-120). A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences shown in Table 1 and/or Table 2 (transcript sequences are provided in Table 1 as SEQ ID NOS:1-60, genomic sequences are provided in Table 2 as SEQ ID NOS:201-250, transcript-based SNP context sequences are provided in Table 1 as SEQ ID NO:121-250, and genomic-based SNP context sequences are provided in Table 2 as SEQ ID NO:251-410), or any nucleic acid molecule that encodes any of the variant proteins provided in Table 1 (SEQ ID NOS:61-120). A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are provided in Table 1 as SEQ ID NOS:1-60, genomic sequences are provided in Table 2 as SEQ ID NOS:201-250, transcript-based SNP context sequences are provided in Table 1 as SEQ ID NO:121-250, and genomic-based SNP context sequences are provided in Table 2 as SEQ ID NO:251-25 410), or any nucleic acid molecule that encodes any of the variant proteins provided in Table 1 (SEQ ID NOS:61-120). A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art (Sambrook and Russell, 2000, Molecular Cloning: A Laboratory Manual, Cold Spring Harbor Press, NY).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof (Sambrook and Russell, 2000, Molecular Cloning: A Laboratory Manual, Cold Spring Harbor Press, NY). Furthermore, isolated nucleic acid molecules, particularly SNP detection reagents such as probes and primers, can also be partially or completely in the form of one or more types of nucleic acid analogs, such as peptide nucleic acid (PNA) (U.S. Pat. Nos. 5,539,082; 5,527,675; 5,623,049; 5,714,331). The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art (see, e.g., Corey, "Peptide nucleic acids: expanding the scope of nucleic acid recognition", *Trends Biotechnol.* 1997 June; 15(6):224-9, and Hyrup et al., "Peptide nucleic acids (PNA): synthesis, properties and potential applications", *Bioorg Med Chem.* 1996 January;4(1):5-23). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2.

Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone (Lagriffoul et al., Bioorganic & Medicinal Chemistry Letters, 4: 1081-1082 (1994), Petersen et al., Bioorganic & Medicinal Chemistry Letters, 6: 793-796 (1996), Kumar et al., Organic Letters 3(9): 1269-1272 (2001), WO96/04000). PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1-2). Variation can occur in either or both the coding and non-coding regions. The variations can produce conservative and/or non-conservative amino acid substitutions.

Further variants of the nucleic acid molecules disclosed in Tables 1-2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences shown in Tables 1-2, and can encode a polypeptide that varies to some degree from the specific polypeptide sequences shown in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. (*Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part* 1, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). In a preferred embodiment, the percent identity between two amino acid sequences is determined using the Needleman and Wunsch algorithm (*J. Mol. Biol.* (48):444-453 (1970)) which has been incorporated into the GAP program in the GCG software package, using either a Blossom 62 matrix or a PAM250 matrix, and a gap weight of 16, 14, 12, 10, 8, 6,or 4 and a length weight of 1, 2, 3, 4, 5, or 6.

In yet another preferred embodiment, the percent identity between two nucleotide sequences is determined using the GAP program in the GCG software package (Devereux, J., et al., *Nucleic Acids Res.* 12(1):387 (1984)), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases to, for example, identify other family members or related sequences. Such searches can be performed using the NBLAST and XBLAST programs (version 2.0) of Altschul, et al. (*J. Mol. Biol.* 215: 403-10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (*Nucleic Acids Res.* 25(17):3389-3402 (1997)). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol. Biol.* 25, 365-389 (1994)) and KERR (Dufresne et al., *Nat Biotechnol* 2002 December;20(12): 1269-71). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (provided in Table 1 as SEQ ID NOS:1-60), genomic sequences (provided in Table 2 as SEQ ID NOS:201-250), and context sequences (transcript-based context sequences are provided in Table 1 as SEQ ID NOS:121-200; genomic-based context sequences are provided in Table 2 as SEQ ID NOS:251-410), can be used for the design of SNP detection reagents. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs provided in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences provided in Table 1 and/or Table 2 (transcript-based context sequences are provided in Table 1 as SEQ ID NOS:121-200; genomic-based context sequences are provided in Table 2 as SEQ ID NOS:251-410). Another example of a detection reagent is a primer which acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g., probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS:1-60), genomic sequences (SEQ ID NOS:201-250), and SNP context sequences (transcript-based context sequences are provided in Table 1 as SEQ ID NOS:121-200; genomic-based context sequences are provided in Table 2 as SEQ ID NOS: 251-410) disclosed in the Sequence Listing and in Tables 1-2. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm which starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides which detect single nucleotide variations in target sequences may be referred to by such terms as "allele-specific oligonucleotides," "allele-specific probes," or "allele-specific primers." The design and use of allele-specific probes for analyzing polymorphisms is described in, e.g., *Mutation Detection A Practical Approach*, ed. Cotton et al. Oxford University Press, 1998; Saiki et al., *Nature* 324, 163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: Prehybridization with a solution containing 5× standard saline phosphate EDTA (SSPE), 0.5% NaDodSO$_4$ (SDS) at 55° C., and incubating probe with target nucleic acid molecules in the same solution at the same temperature, followed by washing with a solution containing 2×SSPE, and 0.1% SDS at 55° C. or room temperature. Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment that is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art. Chemical synthetic methods include, but are limited to, the phosphotriester method described by Narang et al., 1979, Methods in Enzymology 68:90; the phosphodiester method described by Brown et al., 1979, Methods in Enzymology 68:109, the diethylphosphoamidate method described by Beaucage et al., 1981, *Tetrahedron Letters* 22:1859; and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity (Gibbs, 1989, *Nucleic Acid Res.* 17 2427-2448). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118, 801 and 5,312,728), or other stemless or linear beacon probe (Livak et al., 1995, PCR Method Appl. 4:357-362; Tyagi et al., 1996, Nature Biotechnology 14: 303-308; Nazarenko et al., 1997, Nucl. Acids Res. 25:2516-2521; U.S. Pat. Nos. 5,866,336 and 6,117,635).

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems", as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g., TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g., a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays", "microarrays", and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in U.S. Pat. No. 5,837,832, Chee et al., PCT application WO95/11995 (Chee et al.), Lockhart, D. J. et al. (1996; *Nat. Biotech.* 14: 1675-1680) and Schena, M. et al. (1996; *Proc. Natl. Acad Sci.* 93: 10614-10619), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics", *Biotechnol Annu Rev.* 2002;8:85-101; Sosnowski et al., "Active microelectronic array system for DNA hybridization, genotyping and pharmacogenomic applications", *Psychiatr Genet.* 2002 December;12(4):181-92; Heller, "DNA microarray technology: devices, systems, and applications", *Annu Rev Biomed Eng.* 2002;4:129-53. Epub Mar. 22, 2002; Kolchinsky et al., "Analysis of SNPs and other genomic variations using gel-based chips", *Hum Mutat.* 2002 April;19(4):343-60; and McGall et al., "High-density genechip oligonucleotide probe arrays", *Adv Biochem Eng Biotechnol.* 2002;77:21-42.

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology*, John Wiley & Sons, N.Y. (1989), 6.3.1-6.3.6.

In other embodiments, the arrays are used in conjunction with chemiluminescent detection technology. The following patents and patent applications, which are all hereby incorporated by reference, provide additional information pertaining to chemiluminescent detection: U.S. patent application Ser. Nos. 10/620332 and 10/620333 describe chemiluminescent approaches for microarray detection; U.S. Pat. Nos. 6,124,478, 6,107,024, 5,994,073, 5,981,768, 5,871,938, 5,843,681, 5,800,999, and 5,773,628 describe methods and compositions of dioxetane for performing chemiluminescent detection; and U.S. published application US2002/0110828 discloses methods and compositions for microarray controls.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an inkjet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells), biopsies, buccal swabs or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM 6700, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art (see, e.g., Weigl et al., "Lab-on-a-chip for drug development", Adv Drug Deliv Rev.Feb. 24, 2003; 55(3):349-77). In such microfluidic devices, the containers may be referred to as, for example, microfluidic "compartments", "chambers", or "channels".

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micro-machined channels and to change the liquid flow rate for pumping across different sections of the microchip. See, for example, U.S. Pat. Nos. 6,153,073, Dubrow et al., and U.S. Pat. No. 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, especially in predicting an individual's risk for developing a cardiovascular disorder (particularly the risk for experiencing a first or recurrent acute coronary event such as a myocardial infarction or stroke), for prognosing the progression of a cardiovascular disorder in an individual (e.g., the severity or consequences of an acute coronary event), in evaluating the likelihood of an individual who has a cardiovascular disorder of responding to treatment of the cardiovascular disorder with statin, and/or predicting the likelihood that the individual will experience toxicity or other undesirable side effects from the statin treatment, etc. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule provided in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations (Sambrook and Russell, 2000, Molecular Cloning: A Laboratory Manual, Cold Spring Harbor Press, Cold Spring Harbor, N.Y.). Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphisms is likely or unlikely to develop a cardiovascular disorder such as an acute coronary event, or the likelihood that an individual will respond positively to statin treatment of a cardiovascular disorder. Detection of a SNP associated with a disease phenotype provides a diagnostic tool for an active disease and/or genetic predisposition to the disease.

Furthermore, the nucleic acid molecules of the invention are therefore useful for detecting a gene (gene information is disclosed in Table 2, for example) which contains a SNP disclosed herein and/or products of such genes, such as expressed mRNA transcript molecules (transcript information is disclosed in Table 1, for example), and are thus useful for detecting gene expression. The nucleic acid molecules can optionally be implemented in, for example, an array or kit format for use in detecting gene expression.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences provided in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allow, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which specific nucleotide (i.e., allele) is present at each of one or more SNP positions, such as a SNP position in a nucleic acid molecule disclosed in Table 1 and/or Table 2, is referred to as SNP genotyping. The present invention provides methods of SNP genotyping, such as for use in evaluating an individual's risk for developing a cardiovascular disease—particularly an acute coronary event (such as myocardial infarction or stroke) and for evaluating an individual's prognosis for disease severity and recovery, for predicting the likelihood that an individual who has previously experienced an acute coronary event will experience one or more recurrent acute coronary events, for implementing a preventive or treatment regimen for an individual based on that individual having an increased susceptibility for developing a cardiovascular disorder (e.g., increased risk for experiencing one or more myocardial infarctions or strokes), in evaluating an individual's likelihood of responding to statin treatment for cardiovascular disease, in selecting a treatment regimen (e.g., in deciding whether or not to administer statin treatment to an individual having a cardiovascular disease, or in formulating or selecting a particular statin-based treatment regimen such as dosage and/or frequency of administration of statin treatment or choosing which form/type of statin to be administered such as a particular pharmaceutical composition or compound, etc.), determining the likelihood of experiencing toxicity or other undesirable side effects from the statin treatment, or selecting individuals for a clinical trial of a statin (e.g., selecting individuals to participate in the trial who are most likely to respond positively from the statin treatment), etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput", *Pharmacogenomics J.* 2003; 3(2):77-96; Kwok et al., "Detection of single nucleotide polymorphisms", *Curr Issues Mol Biol.* 2003 April; 5(2):43-60; Shi, "Technologies for individual genotyping: detection of genetic polymorphisms in drug targets and disease genes", *Am J Pharmacogenomics.* 2002;2(3):197-205; and Kwok, "Methods for genotyping single nucleotide polymorphisms", *Annu Rev Genomics Hum Genet* 2001; 2:235-58. Exemplary techniques for high-throughput SNP genotyping are described in Marnellos, "High-throughput SNP analysis for genetic association studies", *Curr Opin Drug Discov Devel.* 2003 May;6(3):317-21. Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay.

Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al., *PNAS* 85:4397 (1988); and Saleeba et al., *Meth. Enzymol.* 217:286-295 (1992)), comparison of the electrophoretic mobility of variant and wild type nucleic acid molecules (Orita et al., *PNAS* 86:2766 (1989); Cotton et al., *Mutat. Res.* 285:125-144 (1993); and Hayashi et al., *Genet. Anal. Tech. Appl.* 9:73-79 (1992)), and assaying the movement of polymorphic or wild-type fragments in polyacrylamide gels containing a gradient of denaturant using denaturing gradient gel electrophoresis (DGGE) (Myers et al., Nature 313:495 (1985)). Sequence variations at specific locations can also be assessed by nuclease protection assays such as RNase and S1 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in screening for individuals who are susceptible to developing a cardiovascular disorder (e.g., an acute coronary event) or in screening individuals who have a cardiovascular disorder for their likelihood of responding to statin treatment. These probes and primers can be readily incorporated into a kit format. The present invention also includes modifications of the Taqman assay well known in the art such as the use of Molecular Beacon probes (U.S. Pat. Nos. 5,118,801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA: U.S. Pat. Nos. 6,027,889, 6,268,148, 5,494,810, 5,830,711, and 6,054,564 describe OLA strategies for performing SNP detection; WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array; U.S. application US01/17329 (and 09/584,905) describes OLA (or LDR) followed by PCR, wherein zipcodes are incorporated into OLA probes, and amplified PCR products are determined by electrophoretic or universal zipcode array readout; U.S. application 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry", *Rapid Commun Mass Spectrom.* 2003;17(11):1195-202.

The following references provide further information describing mass spectrometry-based methods for SNP genotyping: Bocker, "SNP and mutation discovery using base-specific cleavage and MALDI-TOF mass spectrometry", *Bioinformatics.* 2003 July;19 Suppl 1:I44-I53; Storm et al., "MALDI-TOF mass spectrometry-based SNP genotyping", *Methods Mol Biol.* 2003;212:241-62; Jurinke et al., "The use of MassARRAY technology for high throughput genotyping", *Adv Biochem Eng Biotechnol.* 2002;77:57-74; and Jurinke et al., "Automated genotyping using the DNA MassArray technology", *Methods Mol Biol.* 2002; 187:179-92.

SNPs can also be scored by direct DNA sequencing. A variety of automated sequencing procedures can be utilized ((1995) *Biotechniques* 19:448), including sequencing by mass spectrometry (see, e.g., PCT International Publication No. WO94/16101; Cohen et al., *Adv. Chromatogr.* 36:127-162 (1996); and Griffin et al., *Appl. Biochem. Biotechnol.* 38:147-159 (1993)). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730xl DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE) (Myers et al., *Nature* 313:495 (1985)). SSCP identifies base differences by alteration in electrophoretic migration of single stranded PCR products, as described in Orita et al., *Proc. Nat. Acad.* Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel (Erlich, ed., PCR Technology, *Principles and Applications for DNA Amplification*, W. H. Freeman and Co, New York, 1992, Chapter 7).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying a patient population for clinical trial for a treatment regimen, predicting the likelihood that an individual will experience toxic side effects from a therapeutic agent, and human identification applications such as forensics.

Analysis of Genetic Association Between SNPS and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies (*Modern Epidemiology*, Lippincott Williams & Wilkins (1998), 609-622). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-square tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease (*Genetic Data Analysis*, Weir B., Sinauer (1990)).

To test whether an allele of a single SNP is associated with the case or control status of a phenotypic trait, one skilled in the art can compare allele frequencies in cases and controls. Standard chi-square tests and Fisher exact tests can be carried out on a 2×2 table (2 SNP alleles×2 outcomes in the categorical trait of interest). To test whether genotypes of a SNP are associated, chi-square tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95% nn.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions) (Applied Logistic Regression, Hosmer and Lemeshow, Wiley (2000)). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $R^2$, are typically calculated for the markers within a gene to elucidate the haplotype structure. Recent studies (Daly et al, *Nature Genetics*, 29, 232-235, 2001) in linkage disequilibrium indicate that SNPs within a gene are organized in block pattern, and a high degree of linkage disequilibrium exists within blocks and very little linkage disequilibrium exists between blocks. Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed (Schaid et al, *Am. J. Hum. Genet.*, 70, 425-434, 2002) that score tests can be done on haplotypes using the program "haplo.score". In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the p-value of the tests reaches that level. In an exploratory analysis where positive hits will be followed up in subsequent confirmatory testing, an unadjusted p-value <0.1 (a significance level on the lenient side) may be used for generating hypotheses for significant association of a SNP with certain phenotypic characteristics of a disease. It is preferred that a p-value <0.05 (a significance level traditionally used in the art) is achieved in order for a SNP to be considered to have an association with a disease. It is more preferred that a p-value <0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wise error rates at 0.05. While there are different methods to adjust for multiple testing to control for different kinds of error rates, a commonly used but rather conservative method is Bonferroni correction to control the experiment-wise or family-wise error rate (*Multiple comparisons and multiple tests*, Westfall et al, SAS Institute (1999)). Permutation tests to control for the false discovery rates, FDR, can be more powerful (Benjamini and Hochberg, Journal of the Royal Statistical Society, Series B 57, 1289-1300, 1995, *Resampling-based Multiple Testing*, Westfall and Young, Wiley (1993)). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies (*Modern Epidemiology*, Lippincott Williams & Wilkins, 1998, 643-673). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies (Ewens and Spielman, *Am. J. Hum. Genet.* 62, 450-458, 1995) when prevalence of the disease is associated with different subpopulation groups. Such bias can also lead to a loss of statistical power in genetic association studies. To detect population stratification, Pritchard and Rosenberg (Pritchard et al. *Am. J. Hum. Gen.* 1999, 65:220-228) suggested typing markers that are unlinked to the disease and using results of association tests on those markers to determine whether there is any population stratification. When stratification is detected, the genomic control (GC) method as proposed by Devlin and Roeder (Devlin et al. *Biometrics* 1999, 55:997-1004) can be used to adjust for the inflation of test statistics due to population stratification. GC method is robust to changes in population structure levels as well as being applicable to DNA pooling designs (Devlin et al. *Genet. Epidem.* 20001, 21:273-284).

While Pritchard's method recommended using 15-20 unlinked microsatellite markers, it suggested using more than 30 biallelic markers to get enough power to detect population stratification. For the GC method, it has been shown (Bacanu et al. *Am. J. Hum. Genet.* 2000, 66:1933-1944) that about 60-70 biallelic markers are sufficient to estimate the inflation factor for the test statistics due to population stratification. Hence, 70 intergenic SNPs can be chosen in unlinked regions as indicated in a genome scan (Kehoe et al. *Hum. Mol. Genet.* 1999, 8:237-245).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks (*Applied Regression Analysis*, Draper and Smith, Wiley (1998)). Moreover, other techniques can also be used for setting up classification. Such techniques include, but are not limited to, MART, CART, neural network, and discriminant analyses that are suitable for use in comparing the performance of different methods (*The Elements of Statistical Learning*, Hastie, Tibshirani & Friedman, Springer (2002)).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the susceptibility allele(s).

The SNPs of the invention may contribute to cardiovascular disorders such as acute coronary events, or to responsiveness of an individual to statin treatment, in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose", "diagnosis", and "diagnostics" include, but are not limited to any of the following: detection of a cardiovascular disorders that an individual may presently have, predisposition/susceptibility screening (e.g., determining whether an individual has an increased risk of experiencing an acute coronary event in the future, or determining whether an individual has a decreased risk of experiencing an acute coronary event in the future), determining a particular type or subclass of cardiovascular disorder in an individual known to currently have or to have previously experienced a cardiovascular disorder, confirming or reinforcing a previously made diagnosis of a cardiovascular disorder, evaluating an individual's likelihood of responding to statin treatment for cardiovascular disorders, predisposition screening (e.g., evaluating an individual's likelihood of responding to statin treatment if the individual were to develop a cardiovascular disorder in the future), determining a particular type or subclass of responder/non-responder in an individual known to respond or not respond to statin treatment, confirming or reinforcing a previously made classification of an individual as a responder/non-responder to statin treatment, pharmacogenomic evaluation of an individual to determine which therapeutic strategy that individual is most likely to positively respond to or to predict whether a patient is likely to respond to a particular treatment such as statin treatment, predicting whether a patient is likely to experience toxic effects from a particular treatment or therapeutic compound, and evaluating the future prognosis of an individual having a cardiovascular disorder. Such diagnostic uses are based on the SNPs individually or in a unique combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium". In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic purposes and similar uses, if a particular SNP site is found to be useful for, for example, predicting an individual's susceptibility to an acute coronary event or an individual's response to statin treatment, then the skilled artisan would recognize that other SNP sites which are in LD with this SNP site would also be useful for predicting an individual's response to statin treatment. Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome. Thus, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., responder/non-responder to statin treatment) that is influenced by the causative SNP(s). Therefore, polymorphic markers that are in LD with causative polymorphisms are useful as diagnostic markers, and are particularly useful when the actual causative polymorphism(s) is/are unknown.

Examples of polymorphisms that can be in LD with one or more causative polymorphisms (and/or in LD with one or more polymorphisms that have a significant statistical association with a condition) and therefore useful for diagnosing the same condition that the causative/associated SNP(s) is used to diagnose, include, for example, other SNPs in the same gene, protein-coding, or mRNA transcript-coding region as the causative/associated SNP, other SNPs in the same exon or same intron as the causative/associated SNP, other SNPs in the same haplotype block as the causative/associated SNP, other SNPs in the same intergenic region as the causative/associated SNP, SNPs that are outside but near a gene (e.g., within 6 kb on either side, 5' or 3', of a gene boundary) that harbors a causative/associated SNP, etc. Such useful LD SNPs can be selected from among the SNPs disclosed in Tables 1-2, for example.

Linkage disequilibrium in the human genome is reviewed in: Wall et al., "Haplotype blocks and linkage disequilibrium in the human genome", *Nat Rev Genet.* 2003 August;4(8): 587-97; Garner et al., "On selecting markers for association studies: patterns of linkage disequilibrium between two and three diallelic loci", *Genet Epidemiol.* 2003 January;24(1): 57-67; Ardlie et al., "Patterns of linkage disequilibrium in the human genome", *Nat Rev Genet.* 2002 April;3(4):299-309 (erratum in *Nat Rev Genet* 2002 July;3(7):566); and Remm et al., "High-density genotyping and linkage disequilibrium in the human genome using chromosome 22 as a model"; *Curr Opin Chem Biol.* 2002 February;6(1):24-30; Haldane JBS (1919) The combination of linkage values, and the calculation of distances between the loci of linked factors. J Genet 8:299-309; Mendel, G. (1866) Versuche über Pflanzen-Hybriden. Verhandlungen des naturforschenden Vereines in Brünn [Proceedings of the Natural History Society of Brünn]; Lewin B (1990) *Genes* IV Oxford University Press, New York, USA; Hartl D L and Clark A G (1989) *Principles of Population Genetics* 2$^{nd}$ ed. Sinauer Associates, Inc. Sunderland, Mass., USA; Gillespie J H (2004) *Population Genetics:*

*A Concise Guide.* 2nd ed. Johns Hopkins University Press. USA; Lewontin R C (1964) The interaction of selection and linkage. I. General considerations; heterotic models. Genetics 49:49-67; Hoel P G (1954) *Introduction to Mathematical Statistics* 2nd ed. John Wiley & Sons, Inc. New York, USA; Hudson R R (2001) Two-locus sampling distributions and their application. Genetics 159:1805-1817; Dempster A P, Laird N M, Rubin D B (1977) Maximum likelihood from incomplete data via the EM algorithm. J R Stat Soc 39:1-38; Excoffier L, Slatkin M (1995) Maximum-likelihood estimation of molecular haplotype frequencies in a diploid population. Mol Biol Evol 12(5):921-927; Tregouet D A, Escolano S, Tiret L, Mallet A, Golmard J L (2004) A new algorithm for haplotype-based association analysis: the Stochastic-EM algorithm. Ann Hum Genet 68(Pt 2):165-177; Long A D and Langley C H (1999) The power of association studies to detect the contribution of candidate genetic loci to variation in complex traits. Genome Research 9:720-731; Agresti A (1990) *Categorical Data Analysis.* John Wiley & Sons, Inc. New York, USA; Lange K (1997) Mathematical and *Statistical Methods for Genetic Analysis*. Springer-Verlag New York, Inc. New York, USA; The International HapMap Consortium (2003) The International HapMap Project. Nature 426:789-796; The International HapMap Consortium (2005) A haplotype map of the human genome. Nature 437:1299-1320; Thorisson G A, Smith A V, Krishnan L, Stein L D (2005), The International HapMap Project Web Site. Genome Research 15:1591-1593; McVean G, Spencer C C A, Chaix R (2005) Perspectives on human genetic variation from the HapMap project. PLoS Genetics 1(4):413-418; Hirschhorn J N, Daly M J (2005) Genome-wide association studies for common diseases and complex traits. Nat Genet 6:95-108; Schrodi S J (2005) A probabilistic approach to large-scale association scans: a semi-Bayesian method to detect disease-predisposing alleles. SAGMB 4(1):3 1; Wang W Y S, Barratt B J, Clayton D G, Todd J A (2005) Genome-wide association studies: theoretical and practical concerns. Nat Rev Genet 6:109-118. Pritchard J K, Przeworski M (2001) Linkage disequilibrium in humans: models and data. Am J Hum Genet 69:1-14.

As discussed above, one aspect of the present invention is the discovery that SNPs which are in certain LD distance with the interrogated SNP can also be used as valid markers for identifying an increased or decreased risks of having or developing CHD. As used herein, the term "interrogated SNP" refers to SNPs that have been found to be associated with an increased or decreased risk of disease using genotyping results and analysis, or other appropriate experimental method as exemplified in the working examples described in this application. As used herein, the term "LD SNP" refers to a SNP that has been characterized as a SNP associating with an increased or decreased risk of diseases due to their being in LD with the "interrogated SNP" under the methods of calculation described in the application. Below, applicants describe the methods of calculation with which one of ordinary skilled in the art may determine if a particular SNP is in LD with an interrogated SNP. The parameter $r^2$ is commonly used in the genetics art to characterize the extent of linkage disequilibrium between markers (Hudson, 2001). As used herein, the term "in LD with" refers to a particular SNP that is measured at above the threshold of a parameter such as $r^2$ with an interrogated SNP.

It is now common place to directly observe genetic variants in a sample of chromosomes obtained from a population. Suppose one has genotype data at two genetic markers located on the same chromosome, for the markers A and B. Further suppose that two alleles segregate at each of these two markers such that alleles $A_1$ and $A_2$ can be found at marker A and alleles $B_1$ and $B_2$ at marker B. Also assume that these two markers are on a human autosome. If one is to examine a specific individual and find that they are heterozygous at both markers, such that their two-marker genotype is $A_1A_2B_1B_2$, then there are two possible configurations: the individual in question could have the alleles $A_1B_1$ on one chromosome and $A_2B_2$ on the remaining chromosome; alternatively, the individual could have alleles $A_1B_2$ on one chromosome and $A_2B_1$ on the other. The arrangement of alleles on a chromosome is called a haplotype. In this illustration, the individual could have haplotypes $A_1B_1/A_2B_2$ or $A_1B_2/A_2B_1$ (see Hartl and Clark (1989) for a more complete description). The concept of linkage equilibrium relates the frequency of haplotypes to the allele frequencies.

Assume that a sample of individuals is selected from a larger population. Considering the two markers described above, each having two alleles, there are four possible haplotypes: $A_1B_1, A_1B_2, A_2B_1$, and $A_2B_2$. Denote the frequencies of these four haplotypes with the following notation.

$$P_{11} = \text{freq}(A_1B_1) \tag{1}$$

$$P_{12} = \text{freq}(A_1B_2) \tag{2}$$

$$P_{21} = \text{freq}(A_2B_1) \tag{3}$$

$$P_{22} = \text{freq}(A_2B_2) \tag{4}$$

The allele frequencies at the two markers are then the sum of different haplotype frequencies, it is straightforward to write down a similar set of equations relating single-marker allele frequencies to two-marker haplotype frequencies:

$$p_1 = \text{freq}(A_1) = P_{11} + P_{12} \tag{5}$$

$$p_2 = \text{freq}(A_2) = P_{21} + P_{22} \tag{6}$$

$$q_1 = \text{freq}(B_1) = P_{11} + P_{21} \tag{7}$$

$$q_2 = \text{freq}(B_2) = P_{12} + P_{22} \tag{8}$$

Note that the four haplotype frequencies and the allele frequencies at each marker must sum to a frequency of 1.

$$P_{11} + P_{12} + P_{21} + P_{22} = 1 \tag{9}$$

$$p_1 + p_2 = 1 \tag{10}$$

$$q_1 + q_2 = 1 \tag{11}$$

If there is no correlation between the alleles at the two markers, one would expect that the frequency of the haplotypes would be approximately the product of the composite alleles. Therefore, $$P_{11} \approx p_1 q_1 \tag{12}$$

$$P_{12} \approx p_1 q_2 \tag{13}$$

$$P_{21} \approx p_2 q_1 \tag{14}$$

$$P_{22} \approx p_2 q_2 \tag{15}$$

These approximating equations (12)-(15) represent the concept of linkage equilibrium where there is independent assortment between the two markers—the alleles at the two markers occur together at random. These are represented as approximations because linkage equilibrium and linkage disequilibrium are concepts typically thought of as properties of a sample of chromosomes; and as such they are susceptible to stochastic fluctuations due to the sampling process. Empirically, many pairs of genetic markers will be in linkage equilibrium, but certainly not all pairs.

Having established the concept of linkage equilibrium above, applicants can now describe the concept of linkage disequilibrium (LD), which is the deviation from linkage equilibrium. Since the frequency of the $A_1B_1$ haplotype is approximately the product of the allele frequencies for $A_1$ and $B_1$ under the assumption of linkage equilibrium as stated mathematically in (12), a simple measure for the amount of departure from linkage equilibrium is the difference in these two quantities, D, $$D = P_{11} - p_1 q_1 \quad (16)$$

D=0 indicates perfect linkage equilibrium. Substantial departures from D=0 indicates LD in the sample of chromosomes examined. Many properties of D are discussed in Lewontin (1964) including the maximum and minimum values that D can take. Mathematically, using basic algebra, it can be shown that D can also be written solely in terms of haplotypes:

$$D = P_{11}P_{22} - P_{12}P_{21} \quad (17)$$

If one transforms D by squaring it and subsequently dividing by the product of the allele frequencies of $A_1$, $A_2$, $B_1$ and $B_2$, the resulting quantity, called $r^2$, is equivalent to the square of the Pearson's correlation coefficient commonly used in statistics (e.g. Hoel, 1954).

$$r^2 = \frac{D^2}{p_1 p_2 q_1 q_2} \quad (18)$$

As with D, values of $r^2$ close to 0 indicate linkage equilibrium between the two markers examined in the sample set. As values of $r^2$ increase, the two markers are said to be in linkage disequilibrium. The range of values that $r^2$ can take are from 0 to 1. $r^2=1$ when there is a perfect correlation between the alleles at the two markers.

In addition, the quantities discussed above are sample-specific. And as such, it is necessary to formulate notation specific to the samples studied. In the approach discussed here, three types of samples are of primary interest: (i) a sample of chromosomes from individuals affected by a disease-related phenotype (cases), (ii) a sample of chromosomes obtained from individuals not affected by the disease-related phenotype (controls), and (iii) a standard sample set used for the construction of haplotypes and calculation pairwise linkage disequilibrium. For the allele frequencies used in the development of the method described below, an additional subscript will be added to denote either the case or control sample sets.

$$P_{1,cs} = \text{freq}(A_1 \text{ in cases}) \quad (19)$$

$$P_{2,cs} = \text{freq}(A_2 \text{ in cases}) \quad (20)$$

$$q_{1,cs} = \text{freq}(B_1 \text{ in cases}) \quad (21)$$

$$q_{2,cs} = \text{freq}(B_2 \text{ in cases}) \quad (22)$$

Similarly, $$p_{1,ct} = \text{freq}(A_1 \text{ in controls}) \quad (23)$$

$$p_{2,ct} = \text{freq}(A_2 \text{ in controls}) \quad (24)$$

$$q_{1,ct} = \text{freq}(B_1 \text{ in controls}) \quad (25)$$

$$q_{2,ct} = \text{freq}(B_2 \text{ in controls}) \quad (26)$$

As a well-accepted sample set is necessary for robust linkage disequilibrium calculations, data obtained from the International HapMap project (The International HapMap Consortium 2003, 2005; Thorisson et al, 2005; McVean et al, 2005) can be used for the calculation of pairwise $r^2$ values. Indeed, the samples genotyped for the International HapMap Project were selected to be representative examples from various human sub-populations with sufficient numbers of chromosomes examined to draw meaningful and robust conclusions from the patterns of genetic variation observed. The International HapMap project website (hapmap.org) contains a description of the project, methods utilized and samples examined. It is useful to examine empirical data to get a sense of the patterns present in such data.

Haplotype frequencies were explicit arguments in equation (18) above. However, knowing the 2-marker haplotype frequencies requires that phase to be determined for doubly heterozygous samples. When phase is unknown in the data examined, various algorithms can be used to infer phase from the genotype data. This issue was discussed earlier where the doubly heterozygous individual with a 2-SNP genotype of $A_1A_2B_1B_2$ could have one of two different sets of chromosomes: $A_1B_1/A_2B_2$ or $A_1B_2/A_2B_1$. One such algorithm to estimate haplotype frequencies is the expectation-maximization (EM) algorithm first formalized by Dempster et al (1977). This algorithm is often used in genetics to infer haplotype frequencies from genotype data (e.g. Excoffier and Slatkin, 1995; Tregouet et al, 2004). It should be noted that for the two-SNP case explored here, EM algorithms have very little error provided that the allele frequencies and sample sizes are not too small. The impact on $r^2$ values is typically negligible.

As correlated genetic markers share information, interrogation of SNP markers in LD with a disease-associated SNP marker can also have sufficient power to detect disease association (Long and Langley, 1999). The relationship between the power to directly find disease-associated alleles and the power to indirectly detect disease-association was investigated by Pritchard and Przeworski (2001). In a straight-forward derivation, it can be shown that the power to detect disease association indirectly at a marker locus in linkage disequilibrium with a disease-association locus is approximately the same as the power to detect disease-association directly at the disease-association locus if the sample size is increased by a factor of $1/r^2$ (the reciprocal of equation 18) at the marker in comparison with the disease-association locus. Therefore, if one calculated the power to detect disease-association indirectly with an experiment having N samples, then equivalent power to directly detect disease-association (at the actual disease-susceptibility locus) would necessitate an experiment using approximately $r^2 N$ samples. This elementary relationship between power, sample size and linkage disequilibrium can be used to derive an $r^2$ threshold value useful in determining whether or not genotyping markers in linkage disequilibrium with a SNP marker directly associated with disease status has enough power to indirectly detect disease-association.

To commence a derivation of the power to detect disease-associated markers through an indirect process, define the effective chromosomal sample size as $$n = \frac{4N_{cs}N_{ct}}{N_{cs}+N_{ct}}; \tag{27}$$

where $N_{cs}$ and $N_{ct}$ are the numbers of diploid cases and controls, respectively. This is necessary to handle situations where the numbers of cases and controls are not equivalent. For equal case and control sample sizes, $N_{cs}=N_{ct}=N$, the value of the effective number of chromosomes is simply n=2N— as expected. Let power be calculated for a significance level $\alpha$ (such that traditional P-values below $\alpha$ will be deemed statistically significant). Define the standard Gaussian distribution function as $\Phi(\bullet)$. Mathematically, $$\Phi(x) = \frac{1}{\sqrt{2\pi}} \int_{-\infty}^{x} e^{-\frac{\theta^2}{2}} d\theta \tag{28}$$

Alternatively, the following error function notation (Erf) may also be used, $$\Phi(x) = \frac{1}{2}\left[1 + \text{Erf}\left(\frac{x}{\sqrt{2}}\right)\right] \tag{29}$$

For example, $\Phi(1.644854)=0.95$. The value of $r^2$ may be derived to yield a pre-specified minimum amount of power to detect disease association though indirect interrogation. Noting that the LD SNP marker could be the one that is carrying the disease-association allele, therefore that this approach constitutes a lower-bound model where all indirect power results are expected to be at least as large as those interrogated.

Denote by $\beta$ the error rate for not detecting truly disease-associated markers. Therefore, $1-\beta$ is the classical definition of statistical power. Substituting the Pritchard-Pzreworski result into the sample size, the power to detect disease association at a significance level of $\alpha$ is given by the approximation $$1-\beta \cong \Phi\left[\frac{|q_{1,cs}-q_{1,ct}|}{\sqrt{\frac{q_{1,cs}(1-q_{1,cs})+q_{1,ct}(1-q_{1,ct})}{r^2 n}}} - Z_{1-\alpha/2}\right]; \tag{30}$$

where $Z_u$ is the inverse of the standard normal cumulative distribution evaluated at u (u$\in$(0,1)). $Z_u=\Phi^{-1}(u)$, where $\Phi(\Phi^{-1}(u))=\Phi^{-1}(\Phi(u))=u$. For example, setting $\alpha=0.05$, and therefore $1-\alpha/2=0.975$, we obtain $Z_{0.975}=1.95996$. Next, setting power equal to a threshold of a minimum power of T, $$T = \Phi\left[\frac{|q_{1,cs}-q_{1,ct}|}{\sqrt{\frac{q_{1,cs}(1-q_{1,cs})+q_{1,ct}(1-q_{1,ct})}{r^2 n}}} - Z_{1-\alpha/2}\right] \tag{31}$$

and solving for $r^2$, the following threshold $r^2$ is obtained:

$$r_T^2 = \frac{[q_{1,cs}(1-q_{1,cs})+q_{1,ct}(1-q_{1,ct})]}{n(q_{1,cs}-q_{1,ct})^2}[\Phi^{-1}(T)+Z_{1-\alpha/2}] \tag{32}$$

Or, $$r_T^2 = \left(\frac{Z_T + Z_{1-\alpha/2}}{n}\right)\left[\frac{q_{1,cs}-(q_{1,cs})^2+q_{1,ct}-(q_{1,ct})^2}{(q_{1,cs}-q_{1,ct})^2}\right] \tag{33}$$

Suppose that $r^2$ is calculated between an interrogated SNP and a number of other SNPs with varying levels of LD with the interrogated SNP. The threshold value $r_T^2$ is the minimum value of linkage disequilibrium between the interrogated SNP and the potential LD SNPs such that the LD SNP still retains a power greater or equal to T for detecting disease-association. For example, suppose that SNP rs200 is genotyped in a case-control disease-association study and it is found to be associated with a disease phenotype. Further suppose that the minor allele frequency in 1,000 case chromosomes was found to be 16% in contrast with a minor allele frequency of 10% in 1,000 control chromosomes. Given those measurements one could have predicted, prior to the experiment, that the power to detect disease association at a significance level of 0.05 was quite high—approximately 98% using a test of allelic association. Applying equation (32) one can calculate a minimum value of $r^2$ to indirectly assess disease association assuming that the minor allele at SNP rs200 is truly disease-predisposing for a threshold level of power. If one sets the threshold level of power to be 80%, then $r_T^2=0.489$ given the same significance level and chromosome numbers as above. Hence, any SNP with a pairwise $r^2$ value with rs200 greater than 0.489 is expected to have greater than 80% power to detect the disease association. Further, this is assuming the conservative model where the LD SNP is disease-associated only through linkage disequilibrium with the interrogated SNP rs200.

The contribution or association of particular SNPs and/or SNP haplotypes with disease phenotypes, such as susceptibility to acute coronary events or responsiveness to statin treatment, enables the SNPs of the present invention to be used to develop superior diagnostic tests capable of identifying individuals who express a detectable trait, such as predisposition to acute coronary events or responder/non-responder to statin treatment, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with response to statin treatment might indicate a probability of 20% that an individual will respond to statin treatment, whereas detection of five SNPs, each of which correlates with response to statin treatment, might indicate a probability of 80% that an individual will respond to statin treatment. To further increase the accuracy of diagnosis or predisposition screening, analysis of the SNPs of the present invention can be combined with that of other polymorphisms or other risk factors that correlate with response to statin treatment, such as family history.

It will, of course, be understood by practitioners skilled in the treatment or diagnosis of cardiovascular disorders that the present invention generally does not intend to provide an absolute identification of individuals who will or will not experience an acute coronary event or develop another cardiovascular disorder, or those individuals who will or will not respond to statin treatment of cardiovascular disorders, but rather to indicate a certain increased (or decreased) degree or likelihood of responding to statin treatment based on statistically significant association results. However, this information is extremely valuable as it can, for example, indicate that an individual having a cardiovascular disorder should follow a particular statin-based treatment regimen, or should follow an alternative treatment regimen that does not involve statin. This information can also be used to initiate preventive treatments or to allow an individual carrying one or more significant SNPs or SNP haplotypes to foresee warning signs such as minor clinical symptoms of cardiovascular disease, or to have regularly scheduled physical exams to monitor for cardiovascular disorders in order to identify and begin treatment of the disorder at an early stage. Particularly with diseases that are extremely debilitating or fatal if not treated on time, the knowledge of a potential predisposition to the disease or likelihood of responding to available treatments, even if this predisposition or likelihood is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in cardiovascular disorders or during the course of statin treatment.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Pharmacogenomics and Therapeutics/Drug Development

The present invention provides methods for assessing the pharmacogenomics of a subject harboring particular SNP alleles or haplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, *Nature* 405, 857-865 (2000); Gould Rothberg, *Nature Biotechnology* 19, 209-211 (2001); Eichelbaum, *Clin. Exp. Pharmacol. Physiol.* 23(10-11):983-985 (1996); and Linder, *Clin. Chem.* 43(2):254-266 (1997). The clinical outcomes of these variations can result in severe toxicity of therapeutic drugs in certain individuals or therapeutic failure of drugs in certain individuals as a result of individual variation in metabolism.

Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in predicting an individual's predisposition to acute coronary events and other cardiovascular disorders and in predicting an individual's responsiveness to the use of statin for treating cardiovascular disease. Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et. al., *Trends in Biotechnology*, August 2000.). Thus, pharmacogenomics based on the SNPs disclosed herein has the potential to both save lives and reduce healthcare costs substantially.

Pharmacogenomics in general is discussed further in Rose et al., "Pharmacogenetic analysis of clinically relevant genetic polymorphisms", *Methods Mol Med.* 2003;85:225-37. Pharmacogenomics as it relates to Alzheimer's disease and other neurodegenerative disorders is discussed in Cacabelos, "Pharmacogenomics for the treatment of dementia", *Ann Med.* 2002;34(5):357-79, Maimone et al., "Pharmacogenomics of neurodegenerative diseases", *Eur J Pharmacol. Feb.* 9, 2001;413(1):11-29, and Poirier, "Apolipoprotein E: a pharmacogenetic target for the treatment of Alzheimer's disease", *Mol Diagn.* 1999 December;4(4):335-41. Pharmacogenomics as it relates to cardiovascular disorders is discussed in Siest et al., "Pharmacogenomics of drugs affecting the cardiovascular system", *Clin Chem Lab Med.* 2003 April;41 (4):590-9, Mukherjee et al., "Pharmacogenomics in cardiovascular diseases", *Prog Cardiovasc Dis.* 2002 May-June;44 (6):479-98, and Mooser et al., "Cardiovascular pharmacogenetics in the SNP era", *J Thromb Haemost.* 2003 July; 1(7):1398-402. Pharmacogenomics as it relates to cancer is discussed in McLeod et al., "Cancer pharmacogenomics: SNPs, chips, and the individual patient", *Cancer Invest.* 2003;21(4):630-40 and Watters et al., "Cancer pharmacogenomics: current and future applications", *Biochim Biophys Acta. Mar.* 17, 2003;1603(2):99-111.

The SNPs of the present invention also can be used to identify novel therapeutic targets for cardiovascular disorders. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke (ed.), Marcel Dekker, Inc.: New York (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates (see, e.g., Thompson, *Drug Discovery Today*, 7 (17): 912-917 (2002)). Antisense oligonucleotides are directly useful as therapeutic agents, and are also useful for determining and validating gene function (e.g., in gene knock-out or knock-down experiments).

Antisense technology is further reviewed in: Lavery et al., "Antisense and RNAi: powerful tools in drug target discovery and validation", *Curr Opin Drug Discov Devel.* 2003 July;6 (4):561-9; Stephens et al., "Antisense oligonucleotide therapy in cancer", *Curr Opin Mol Ther.* 2003 April;5(2): 118-22; Kurreck, "Antisense technologies. Improvement through novel chemical modifications", *Eur J Biochem.* 2003 April;270(8):1628-44; Dias et al., "Antisense oligonucleotides:

basic concepts and mechanisms", *Mol Cancer Ther.* 2002 March;1(5):347-55; Chen, "Clinical development of antisense oligonucleotides as anti-cancer therapeutics", *Methods Mol Med.* 2003;75:621-36; Wang et al., "Antisense anticancer oligonucleotide therapeutics", *Curr Cancer Drug Targets.* 2001 November;1(3):177-96; and Bennett, "Efficiency of antisense oligonucleotide drug discovery", *Antisense Nucleic Acid Drug Dev.* 2002 June; 12(3):215-24.

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as a cardiovascular disorder, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs (Thompson, *Drug Discovery Today*, 7 (17): 912-917 (2002)). Accordingly, an aspect of the present invention specifically contemplates isolated nucleic acid molecules that are about 18-26 nucleotides in length, preferably 19-25 nucleotides in length, and more preferably 20, 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference", *Nat Biotechnol*. 2004 March;22(3):326-30. Epub 2004 Feb. 1; Chi et al., "Genomewide view of gene silencing by small interfering RNAs", *PNAS* 100(11):6343-6346, 2003; Vickers et al., "Efficient Reduction of Target RNAs by Small Interfering RNA and RNase H-dependent Antisense Agents", *J. Biol. Chem*. 278: 7108-7118, 2003; Agami, "RNAi and related mechanisms and their potential use for therapy", *Curr Opin Chem Biol*. 2002 December;6(6): 829-34; Lavery et al., "Antisense and RNAi: powerful tools in drug target discovery and validation", *Curr Opin Drug Discov Devel*. 2003 July;6(4):561-9; Shi, "Mammalian RNAi for the masses", *Trends Genet* 2003 January;19(1):9-12), Shuey et al., "RNAi: gene-silencing in therapeutic intervention", *Drug Discovery Today* 2002 October;7(20):1040-1046; McManus et al., *Nat Rev Genet* 2002 October;3(10):737-47; Xia et al., *Nat Biotechnol* 2002 October;20(10):1006-10; Plasterk et al., *Curr Opin Genet Dev* 2000 October;10(5): 562-7; Bosher et al., *Nat Cell Biol* 2000 February;2(2):E31-6; and Hunter, *Curr Biol June* 17;9(12):R440-2).

A subject suffering from a pathological condition, such as a cardiovascular disorder, ascribed to a SNP may be treated so as to correct the genetic defect (see Kren et al., *Proc. Natl. Acad Sci. USA* 96:10349-10354 (1999)). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

The invention further provides a method for identifying a compound or agent that can be used to treat cardiovascular disorders. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a patient having a cardiovascular disorder or undergoing statin treatment can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as a cardiovascular disorder that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

The SNP-containing nucleic acid molecules of the present invention are also useful for monitoring the effectiveness of modulating compounds on the expression or activity of a variant gene, or encoded product, in clinical trials or in a treatment regimen. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

In another aspect of the present invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to humans diagnostically tested for one or more SNPs or SNP haplotypes provided by the present invention.

The SNPs/haplotypes of the present invention are also useful for improving many different aspects of the drug development process. For instance, an aspect of the present invention includes selecting individuals for clinical trials based on their SNP genotype. For example, individuals with SNP genotypes that indicate that they are likely to positively respond to a drug can be included in the trials, whereas those individuals whose SNP genotypes indicate that they are less likely to or would not respond to the drug, or who are at risk for suffering toxic effects or other adverse reactions, can be excluded from the clinical trials. This not only can improve the safety of clinical trials, but also can enhance the chances that the trial will demonstrate statistically significant efficacy. Furthermore, the SNPs of the present invention may explain why certain previously developed drugs performed poorly in clinical trials and may help identify a subset of the population that would benefit from a drug that had previously performed poorly in clinical trials, thereby "rescuing" previously developed drugs, and enabling the drug to be made available to a particular patient population that can benefit from it.

SNPs have many important uses in drug discovery, screening, and development. A high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. (Jazwinska, *A Trends Guide to Genetic Variation and Genomic Medicine*, 2002 March; S30-S36).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants (Rothberg, *Nat Biotechnol* 2001 March; 19(3):209-11). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population (Jazwinska, *A Trends Guide to Genetic Variation and Genomic Medicine*, 2002 March; S30-S36).

Additionally, screening therapeutic candidates against all known variants of a target can enable the early identification of potential toxicities and adverse reactions relating to particular drug variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1-2, are useful in conjunction with a variety of toxicology methods established in the art, such as those set forth in *Current Protocols in Toxicology*, John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1-2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

Pharmaceutical Compositions and Administration Thereof

Any of the cardiovascular disease and/or statin response-associated proteins, and encoding nucleic acid molecules, disclosed herein can be used as therapeutic targets (or directly used themselves as therapeutic compounds) for treating cardiovascular disorders and related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70 kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semi-solid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in Remington's Pharmaceutical Sciences, edited by E. W. Martin (Mack Publishing Company, 18th ed., 1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80 wt %.

Therapeutic compounds can be administered alone or in combination with other therapeutic compounds or in combination with one or more other active ingredient(s). For example, an inhibitor or stimulator of a cardiovascular disorder-associated protein can be administered in combination with another agent that inhibits or stimulates the activity of the same or a different cardiovascular disorder-associated protein to thereby counteract the affects of a cardiovascular disorder.

For further information regarding pharmacology, see *Current Protocols in Pharmacology*, John Wiley & Sons, Inc., N.Y.

Human Identification Applications

In addition to their diagnostic and therapeutic uses in cardiovascular disorders and statin treatment of cardiovascular disorders, the SNPs provided by the present invention are also useful as human identification markers for such applications as forensics, paternity testing, and biometrics (see, e.g., Gill, "An assessment of the utility of single nucleotide polymorphisms (SNPs) for forensic purposes", *Int J Legal Med.* 2001; 114(4-5):204-10). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein. For many of the SNPs disclosed in Tables 1-2 (which are identified as "Applera" SNP source), Tables 1-2 provide SNP allele frequencies obtained by re-sequencing the DNA of chromosomes from 39 individuals (Tables 1-2 also provide allele frequency information for "Celera" source SNPs and, where available, public SNPs from dbEST, HGBASE, and/or HGMD). The allele frequencies provided in Tables 1-2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1-2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1-2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1-2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1-2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry", *Journal of Forensic Sciences* 2003; 48(4):771-782.

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationaly more stable than repeat polymorphisms. SNPs are not susceptible to artefacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium (see the section of the present specification entitled "Computer-Related Embodiments").

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms", *Electrophoresis* 1999 June;20(8):1676-81.

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns (see, for example, O'Connor, *Stanford Technology Law Review* and U.S. Pat. No. 6,119,096).

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact.

Further information regarding techniques for using SNPs in forensic/human identification applications can be found in, for example, *Current Protocols in Human Genetics*, John Wiley & Sons, N.Y. (2002), 14.1-14.7.

Variant Proteins, Antibodies, Vectors & Host Cells, & Uses Thereof

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are provided as SEQ ID NOS:61-120 in Table 1 and the Sequence Listing. These variants will generally be referred to herein as variant proteins/peptides/polypeptides, or polymorphic proteins/peptides/polypeptides of the present invention. The terms "protein", "peptide", and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below (Sambrook and Russell, 2000, Molecular Cloning: A Laboratory Manual, Cold Spring Harbor Laboratory Press, Cold Spring Harbor, N.Y.).

The present invention provides isolated variant proteins that comprise, consist of or consist essentially of amino acid sequences that contain one or more variant amino acids encoded by one or more codons which contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems", *Appl Microbiol Biotechnol.* 2003 January;60(5):523-33. Epub 2002 Nov. 7; Graddis et al., "Designing proteins that work using recombinant technologies", *Curr Pharm Biotechnol.* 2002 December;3(4):285-97; and Nilsson et al., "Affinity fusion strategies for detection, purification, and immobilization of recombinant proteins", *Protein Expr Purif.* 1997 October;11(1):1-16.

The present invention also relates to further obvious variants of the variant polypeptides of the present invention, such as naturally-occurring mature forms (e.g., alleleic variants), non-naturally occurring recombinantly-derived variants, and orthologs and paralogs of such proteins that share sequence homology. Such variants can readily be generated using art-known techniques in the fields of recombinant nucleic acid technology and protein biochemistry. It is understood, however, that variants exclude those known in the prior art before the present invention.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in, for example, Bowie et al., Science 247:1306-1310 (1990).

Variant proteins can be fully functional or can lack function in one or more activities, e.g. ability to bind another molecule, ability to catalyze a substrate, ability to mediate signaling, etc.

Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis (Cunningham et al., Science 244:1081-1085 (1989)), particularly using the amino acid sequence and polymorphism information provided in Table 1. The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling (Smith et al., J. Mol. Biol. 224:899-904 (1992); de Vos et al. Science 255:306-312 (1992)).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as *Proteins—Structure and Molecular Properties*, 2nd Ed., T. E. Creighton, W. H. Freeman and Company, New York (1993); Wold, F., *Posttranslational Covalent Modification of Proteins*, B. C. Johnson, Ed., Academic Press, New York 1-12 (1983); Seifter et al., Meth. Enzymol. 182: 626-646 (1990); and Rattan et al., Ann. N.Y. Acad. Sci. 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis) (*Current Protocols in Protein Science*, John Wiley & Sons, N.Y. (2002)).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art (see, e.g., Molecular Cloning: A Laboratory Manual, Cold Spring Harbor Laboratory Press, Sambrook and Russell, 2000, and Methods in Enzymology: Guide to Molecular Cloning Techniques, Academic Press, Berger, S. L. and A. R. Kimmel eds., 1987).

In a specific embodiment of the invention, the methods of the present invention include detection of one or more variant proteins disclosed herein. Variant proteins are disclosed in Table 1 and in the Sequence Listing as SEQ ID NOS: 61-120. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for evaluating an individual's predisposition to developing a cardiovascular disorder, particularly an acute coronary event such as myocardial infarction, or stroke, for treating and/or preventing cardiovascular disorders, of for predicting an individuals response to statin treatment of cardiovascular disorders, etc. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with cardiovascular disorders and/or statin response that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays", *Anal Chem.* 1999 Jun 15;71(12):294R-304R.

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., *Nature* 354:82-84 (1991); Houghten et al., *Nature* 354: 84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., *Cell* 72:767-778 (1993)); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an end-point assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein (Hodgson, *Bio/technology*, 1992, Sept 10(9), 973-80).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as cardiovascular disease. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay (see, e.g., U.S. Pat. No. 5,283,317F; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300) to identify other proteins that bind to or interact with the variant protein and are involved in variant protein activity. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., *Proc. Natl. Acad Sci. USA*, 81:6851, 1984; Neuberger et al., *Nature* 312:604, 1984), a humanized antibody (U.S. Pat. Nos. 5,693,762; 5,585,089; and 5,565,332), a single-chain Fv (U.S. Pat. No. 4,946,778; Ward et al., *Nature* 334:544, 1989), a bispecific antibody with two binding specificities (Segal et al., *J. Immunol. Methods* 248:1, 2001; Carter, *J. Immunol. Methods* 248:7, 2001), a diabody, a triabody, and a tetrabody (Todorovska et al., *J. Immunol. Methods,* 248:47, 2001), as well as a Fab conjugate (dimer or trimer), and a minibody.

Many methods are known in the art for generating and/or identifying antibodies to a given target antigen (Harlow, Antibodies, Cold Spring Harbor Press, (1989)). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology (Kohler and Milstein, *Nature,* 256:495, 1975), which immortalizes cells secreting a specific monoclonal antibody. The immortalized cell lines can be created in vitro by fusing two different cell types, typically lymphocytes, and tumor cells. The hybridoma cells may be cultivated in vitro or in vivo. Additionally, fully human antibodies can be generated by transgenic animals (He et al., *J. Immunol.,* 169:595, 2002). Fd phage and Fd phagemid technologies may be used to generate and select recombinant antibodies in vitro (Hoogenboom and Chames, *Immunol. Today* 21:371, 2000; Liu et al., *J. Mol. Biol.* 315:1063, 2002). The complementarity-determining regions of an antibody can be identified, and synthetic peptides corresponding to such regions may be used to mediate antigen binding (U.S. Pat. No. 5,637,677).

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

Antibodies, particularly the use of antibodies as therapeutic agents, are reviewed in: Morgan, "Antibody therapy for Alzheimer's disease", *Expert Rev Vaccines.* 2003 Feb;2(1): 53-9; Ross et al., "Anticancer antibodies", *Am J Clin Pathol.* 2003 Apr;119(4):472-85; Goldenberg, "Advancing role of radiolabeled antibodies in the therapy of cancer", *Cancer Immunol Immunother.* 2003 May;52(5):281-96. Epub 2003 Mar. 11; Ross et al., "Antibody-based therapeutics in oncology", *Expert Rev Anticancer Ther.* 2003 Feb;3(1):107-21; Cao et al., "Bispecific antibody conjugates in therapeutics", *Adv Drug Deliv Rev.* 2003 Feb. 10;55(2):171-97; von Mehren et al., "Monoclonal antibody therapy for cancer", *Annu Rev Med.* 2003;54:343-69. Epub Dec. 3, 2001; Hudson et al., "Engineered antibodies", *Nat Med.* 2003 Jan;9(1):129-34; Brekke et al., "Therapeutic antibodies for human diseases at the dawn of the twenty-first century", *Nat Rev Drug Discov.* 2003 Jan;2(1):52-62 (Erratum in: *Nat Rev Drug Discov.* 2003 Mar;2(3):240); Houdebine, "Antibody manufacture in transgenic animals and comparisons with other systems", *Curr Opin Biotechnol.* 2002 Dec;13(6):625-9; Andreakos et al., "Monoclonal antibodies in immune and inflammatory diseases", *Curr Opin Biotechnol.* 2002 Dec;13(6):615-20; Kellermann et al., "Antibody discovery: the use of transgenic mice to generate human monoclonal antibodies for therapeutics", *Curr Opin Biotechnol.* 2002 Dec; 13(6):593-7; Pini et al., "Phage display and colony filter screening for high-throughput selection of antibody libraries", *Comb Chem High Throughput Screen.* 2002 Nov;5(7):503-10; Batra et al., "Pharmacokinetics and biodistribution of genetically engineered antibodies", *Curr Opin Biotechnol.* 2002 Dec;13(6): 603-8; and Tangri et al., "Rationally engineered proteins or antibodies with absent or reduced immunogenicity", *Curr Med Chem.* 2002 Dec;9(24):2191-9.

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as in a cardiovascular disorder or during statin treatment. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, such as a cardiovascular disorder, or during the course of a treatment regime, such as during statin treatment. Antibodies specific for a variant protein encoded by a SNP-containing nucleic acid molecule of the present invention can be used to assay for the presence of the variant protein, such as to predict an individual's response to statin treatment or predisposition/susceptibility to an acute coronary event, as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol (Leong et al., *Cytokine* 16:106, 2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in. prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors (see, e.g., Sambrook and Russell, 2000, Molecular Cloning: A Laboratory Manual, Cold Spring Harbor Laboratory Press, Cold Spring Harbor, N.Y.).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, 2000, Molecular Cloning: A Laboratory Manual, Cold Spring Harbor Laboratory Press, Cold Spring Harbor, N.Y.

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *E. coli, Streptomyces*, and *Salmonella typhimurium*. Eukaryotic host cells include, but are not limited to, yeast, insect cells such as *Drosophila*, animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-315 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (Gottesman, S., *Gene Expression Technology: Methods in Enzymology* 185, Academic Press, San Diego, Calif. (1990) 119-128). Alternatively, the sequence of the SNP-containing nucleic acid molecule of interest can be altered to provide preferential codon usage for a specific host cell, for example, *E. coli* (Wada et al., *Nucleic Acids Res.* 20:2111-2118 (1992)).

The SNP-containing nucleic acid molecules can also be expressed by expression vectors that are operative in yeast. Examples of vectors for expression in yeast (e.g., *S. cerevisiae*) include pYepSec1 (Baldari, et al., *EMBO J.* 6:229-234 (1987)), pMFa (Kujan et al., Cell 30:933-943(1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol. Cell Biol.* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (Seed, B. *Nature* 329:840(1987)) and pMT2PC (Kaufinan et al., *EMBO J.* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, 2000, Molecular Cloning: A Laboratory Manual, Cold Spring Harbor Laboratory, Cold Spring Harbor Laboratory Press, Cold Spring Harbor, N.Y.).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described in, for example, U.S. Pat. Nos. 4,736,866 and 4,870,009, both by Leder et al., U.S. Pat. No. 4,873,191 by Wagner et al., and in Hogan, B., *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes.

A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1 (Lakso et al. *PNAS* 89:6232-6236 (1992)). Another example of a recombinase system is the FLP recombinase system of *S. cerevisiae* (O'Gorman et al. *Science* 251: 1351-1355 (1991)). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described in, for example, Wilmut, I. et al. *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context. Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems", *Curr Opin Biotechnol.* 2002 Dec;13(6):625-9; Petters et al., "Transgenic animals as models for human disease", *Transgenic Res.* 2000;9(4-5): 347-51; discussion 345-6; Wolf et al., "Use of transgenic animals in understanding molecular mechanisms of toxicity", *J Pharm Pharmacol.* 1998 Jun;50(6):567-74; Echelard, "Recombinant protein production in transgenic animals", *Curr Opin Biotechnol.* 1996 Oct;7(5):536-40; Houdebine, "Transgenic animal bioreactors", *Transgenic Res.* 2000;9(4-5):305-20; Pirity et al., "Embryonic stem cells, creating transgenic animals", *Methods Cell Biol.* 1998;57:279-93; and Robl et al., "Artificial chromosome vectors and expression of complex proteins in transgenic animals", *Theriogenology.* 2003 Jan. 1;59(1):107-13.

Computer-Related Embodiments

The SNPs provided in the present invention may be "provided" in a variety of mediums to facilitate use thereof. As used in this section, "provided" refers to a manufacture, other than an isolated nucleic acid molecule, that contains SNP information of the present invention. Such a manufacture provides the SNP information in a form that allows a skilled artisan to examine the manufacture using means not directly applicable to examining the SNPs or a subset thereof as they exist in nature or in purified form. The SNP information that may be provided in such a form includes any of the SNP information provided by the present invention such as, for example, polymorphic nucleic acid and/or amino acid sequence information such as SEQ ID NOS:1-60, SEQ ID NOS:61-120, SEQ ID NOS:201-250, SEQ ID NOS:121-200, and SEQ ID NOS:251-410; information about observed SNP alleles, alternative codons, populations, allele frequencies, SNP types, and/or affected proteins; or any other information provided by the present invention in Tables 1-2 and/or the Sequence Listing.

In one application of this embodiment, the SNPs of the present invention can be recorded on a computer readable medium. As used herein, "computer readable medium" refers to any medium that can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable media can be used to create a manufacture comprising computer readable medium having recorded thereon a nucleotide sequence of the present invention. One such medium is provided with the present application, namely, the present application contains computer readable medium (CD-R) that has nucleic acid sequences (and encoded protein sequences) containing SNPs provided/recorded thereon in ASCII text format in a Sequence Listing along with accompanying Tables that contain detailed SNP and sequence information (transcript sequences are provided as SEQ ID NOS:1-60, protein sequences are provided as SEQ ID NOS:61-120, genomic sequences are provided as SEQ ID NOS:201-250, transcript-based context sequences are provided as SEQ ID NOS:121-200, and genomic-based context sequences are provided as SEQ ID NOS:251-410).

As used herein, "recorded" refers to a process for storing information on computer readable medium. A skilled artisan can readily adopt any of the presently known methods for recording information on computer readable medium to generate manufactures comprising the SNP information of the present invention.

A variety of data storage structures are available to a skilled artisan for creating a computer readable medium having recorded thereon a nucleotide or amino acid sequence of the present invention. The choice of the data storage structure will generally be based on the means chosen to access the stored information. In addition, a variety of data processor programs and formats can be used to store the nucleotide/amino acid sequence information of the present invention on computer readable medium. For example, the sequence information can be represented in a word processing text file, formatted in commercially-available software such as WordPerfect and Microsoft Word, represented in the form of an ASCII file, or stored in a database application, such as OB2, Sybase, Oracle, or the like. A skilled artisan can readily adapt any number of data processor structuring formats (e.g., text file or database) in order to obtain computer readable medium having recorded thereon the SNP information of the present invention.

By providing the SNPs of the present invention in computer readable form, a skilled artisan can routinely access the SNP information for a variety of purposes. Computer software is publicly available which allows a skilled artisan to access sequence information provided in a computer readable medium. Examples of publicly available computer software include BLAST (Altschul et at, J. Mol. Biol. 215:403-410 (1990)) and BLAZE (Brutlag et at, Comp. Chem. 17:203-207 (1993)) search algorithms.

The present invention further provides systems, particularly computer-based systems, which contain the SNP information described herein. Such systems may be designed to store and/or analyze information on, for example, a large number of SNP positions, or information on SNP genotypes from a large number of individuals. The SNP information of the present invention represents a valuable information source. The SNP information of the present invention stored/analyzed in a computer-based system may be used for such computer-intensive applications as determining or analyzing SNP allele frequencies in a population, mapping disease genes, genotype-phenotype association studies, grouping SNPs into haplotypes, correlating SNP haplotypes with response to particular drugs, or for various other bioinformatic, pharmacogenomic, drug development, or human identification/forensic applications.

As used herein, "a computer-based system" refers to the hardware means, software means, and data storage means used to analyze the SNP information of the present invention. The minimum hardware means of the computer-based systems of the present invention typically comprises a central processing unit (CPU), input means, output means, and data storage means. A skilled artisan can readily appreciate that any one of the currently available computer-based systems are suitable for use in the present invention. Such a system can be changed into a system of the present invention by utilizing the SNP information provided on the CD-R, or a subset thereof, without any experimentation.

As stated above, the computer-based systems of the present invention comprise a data storage means having stored therein SNPs of the present invention and the necessary hardware means and software means for supporting and implementing a search means. As used herein, "data storage means" refers to memory which can store SNP information of the present invention, or a memory access means which can access manufactures having recorded thereon the SNP information of the present invention.

As used herein, "search means" refers to one or more programs or algorithms that are implemented on the computer-based system to identify or analyze SNPs in a target sequence based on the SNP information stored within the data storage means. Search means can be used to determine which nucleotide is present at a particular SNP position in the target sequence. As used herein, a "target sequence" can be any DNA sequence containing the SNP position(s) to be searched or queried.

As used herein, "a target structural motif," or "target motif," refers to any rationally selected sequence or combination of sequences containing a SNP position in which the sequence(s) is chosen based on a three-dimensional configuration that is formed upon the folding of the target motif. There are a variety of target motifs known in the art. Protein target motifs include, but are not limited to, enzymatic active sites and signal sequences. Nucleic acid target motifs include, but are not limited to, promoter sequences, hairpin structures, and inducible expression elements (protein binding sequences).

A variety of structural formats for the input and output means can be used to input and output the information in the computer-based systems of the present invention. An exemplary format for an output means is a display that depicts the presence or absence of specified nucleotides (alleles) at particular SNP positions of interest. Such presentation can provide a rapid, binary scoring system for many SNPs simultaneously.

One exemplary embodiment of a computer-based system comprising SNP information of the present invention is provided in FIG. 1. FIG. 1 provides a block diagram of a computer system 102 that can be used to implement the present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, a magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable storage medium 116 once inserted in the removable medium storage device 114.

The SNP information of the present invention may be stored in a well-known manner in the main memory 108, any of the secondary storage devices 110, and/or a removable storage medium 116. Software for accessing and processing the SNP information (such as SNP scoring tools, search tools, comparing tools, etc.) preferably resides in main memory 108 during execution.

EXAMPLES

Genetic Polymorphisms Associated with MI and Statin Response

The following examples are offered to illustrate, but not to limit the claimed invention.

Study Designs

In order to identify genetic markers associated with acute coronary events (e.g. MI, stroke, unstable angina, congestive heart failure, etc.) or response to statin treatment for the prevention of coronary events, samples were genotyped in two clinical trials: the Cholesterol and Recurrent Events (CARE) study (a randomized multicentral double-blinded trial on secondary prevention of acute coronary events with pravastatin; Sacks et al., *Am. J. Cardiol.* 68: 1436-1446 [1991]), and the West of Scotland Coronary Prevention Study (WOSCOPS) study (Shepherd et al., *N Eng J Med* 333 (20), pp. 1301-7, Nov. 16, 1995; Packard et al., *N Eng J Med* 343 (16), pp. 1148-55, Oct. 19, 2000).

A well-documented myocardial infarction (MI) was one of the enrollment criteria for entry into the CARE study. Patients were enrolled in the CARE trial from 80 participating study centers. Men and post-menopausal women were eligible for the trial if they had had an acute MI between 3 and 20 months prior to randomization, were 21 to 75 years of age, and had plasma total cholesterol levels of less than 240 mg/deciliter, LDL cholesterol levels of 115 to 174 mgs/deciliter, fasting triglyceride levels of less than 350 mgs/deciliter, fasting glucose levels of no more than 220 mgs/deciliter, left ventricular ejection fractions of no less than 25%, and no symptomatic congestive heart failure. Patients were randomized to receive either 40 mg of pravastatin once daily or a matching placebo. The primary endpoint of the trial was death from coronary heart disease and the median duration of follow-up was 5.0 years (range, 4.0 to 6.2 years). All individuals included in the study had signed informed consent forms and the study protocol was approved by the respective Institutional Review Boards (IRBs).

For genotyping SNPs in CARE patient samples, DNA was extracted from blood samples using conventional DNA extraction methods such as the QIAamp kit from Qiagen. Genotypes were obtained by a method similar to that described by Lannone (M. A. Lannone et al., *Cytometry* 39(2):131-140 [Feb. 1, 2000]; also described in section "SNP DETECTION REAGENTS," supra). Briefly, target DNA was amplified by multiplex PCR, the amplified product was submitted to a multiplex oligo ligation assay (OLA), the specific ligated products were hybridized to unique universal "ZIP code" oligomer sequences covalently attached to Luminex xMAP® Multi-Analyte COOH Microspheres, and these hybridization products/microspheres were detected in a rapid automated multiplex system using the Luminex 100 instrument. Alternatively, allele specific primers were designed for detecting each SNP and genotypes were obtained on an ABI PRISM® 7900HT Sequence Detection PCR system (Applied Biosystems) by allele-specific PCR, similar to the method described by Germer et al (Germer S., Holland M. J., Higuchi R. 2000, *Genome Res.* 10: 258-266).

Genetic markers identified as associated with acute coronary events or response to statin treatment for the prevention of coronary events in the CARE samples were also genotyped in a second sample set, the West of Scotland Coronary Prevention Study (WOSCOPS). The design of the original WOSCOPS cohort and the nested case-control study have been described (Shepherd et al., *N Eng J Med* 333 (20), pp. 1301-7, Nov. 16, 1995; Packard et al., *N Eng J Med* 343 (16), pp. 1148-55, Oct. 19, 2000). The objective of the WOSCOPS trial was to assess pravastatin efficacy at reducing risk of primary MI or coronary death among Scottish men with hypercholesterolemia (fasting LDL cholesterol>155 mg/dl). Participants in the WOSCOPS study were 45-64 years of age and followed for an average of 4.9 years for coronary events. The nested case-control study included as cases all WOSCOPS patients who experienced a coronary event (confirmed nonfatal MI, death from coronary heart disease, or a revascularization procedure; N=580). Controls were age- and smoking-matched unaffected patients. All individuals included in the study had signed informed consent forms and the study protocol was approved by the IRBs. DNA was extracted and genotyped as described above.

Example 1

Genetic Polymorphism hCV3054799 Associated with Risk of MI/RMI and Response to Statin Treatment The association of hCV3054799 with risk of MI in patients was tested in two clinical trials, CARE and WOSCOPS, with patients receiving treatment with either pravastatin or placebo. CARE was a secondary prevention trial (i.e., recurrent MI as endpoint) and WOSCOPS was a primary prevention trial. SNP genotype frequencies in a group of 244 patients who had a second MI during the five years of CARE follow-up (cases) were compared with the frequencies in the group of 2471 CARE patients who did not experience a second MI (controls). To replicate this finding, SNP genotype frequencies in a group of 483 patients who had an MI within the five years of the WOSCOPS follow-up (cases) were compared with the frequencies in the group of 1094 WOSCOPS patients who did not experience MI (controls). The analysis in WOSCOPS (a nested case-control study) was performed using the MI as an endpoint.

Tables 5-7 list the counts of total patients studied, as well as the number of patients in each treatment arm (study strata). Also presented are the counts of specific genotypes observed following the genotyping assays, their frequencies and the frequencies of the two alleles for this SNP. The counts represent the total number of valid genotyping assay results obtained, which in some instances is slightly less than the total number of patients enrolled in the study.

The statistics in Table 8 demonstrate the association of hCV3054799 with MI/RMI. In both the CARE and WOSCOPS studies, an association analysis was performed for each of the two modes of inheritance, dominant and recessive. Additionally, a genotypic test (heterozygote v. major homozygote) and an allelic test of association were performed using Fisher's exact method. Estimates of odds ratios and corresponding ninety-five percent confidence intervals were calculated. The significance of the disease association for hCV3054799 with the overall (unstratified) population, and with the placebo- or pravastatin-treated patients are indicated in Table 8. Analysis of these statistics shows that the association of hCV3054799 with MI risk is especially significant, and is replicated in both CARE and WOSCOPS studies. In patients that are heterozygous carriers of the minor allele, the odds ratio for risk of MI relative to patients with no minor allele is 1.7, with a P value below 0.01 both studies. The odds ratio is approximately the same (1.6-1.7) when calculated for the dominant mode of inheritance (a genotype with one or two minor alleles vs. none), with a P value less than or equal to 0.01 in both studies.

A logistic regression method was used to adjust for major epidemiologic risk factors in the CARE and WOSCOPS study samples (Table 8). In the CARE samples, this method adjusted for the risk factors associated with sex, family history, smoking status, body mass index and hypertension. In the WOSCOPS set, logistic regression was performed to adjust for the risk factors of family history and hypertension. No adjustments were made for sex or smoker status in the WOSCOPS set because all patients were male, and the cases and controls were matched as to smoker status. The odds ratios shown in Table 9 for heterozygous samples clearly confirm the association of hCV3054799 with MI risk, independent of and uninfluenced by other conventional risk factors. As in Table 8, the OR for risk of MI in a heterozygous carrier is approximately 1.7, with P values below 0.01 in both studies.

Also analyzed was whether hCV3054799 is associated with response to statin treatment (specifically, a decreased risk of MI as a result of treatment with pravastatin). Table 10 presents these risk association results. The number of heterozygous patients in the pravastatin treatment group who had a second MI during the five-year followup (cases) were compared with the number of heterozygous individuals who did not experience a second MI (controls). Heterozygous carriers in the placebo treatment group were used as a reference in determining the odds ratios. Results in the columns under the heading "Risk Reduction by Statin" demonstrate the strong association of hCV3054799 with response to pravastatin treatment: an odds ratio of approximately 0.5 for carriers treated with pravastatin, with P values in both studies well below 0.01. These data indicate that carriers of this allele had a reduced risk of having an MI if they received statin treatment and particularly pravistatin treatment. For comparison, the odds ratio for association of this SNP with MI risk in placebo-treated carriers is also presented, under the heading "MI/RMI risk estimation" (data from Table 8; again, heterozygous carriers).

See also Tables 17 and 18 for additional data supporting the conclusion that individuals carrying certain hCV3054799 alleles had an increased risk of developing MI/RMI, and that they responded well to statin treatment. Data in Tables 17 and 18 were derived as follows:

In analyzing the CARE patients, statistical analysis was performed with SAS version 9. Cox proportional hazard models (Wald tests) were used in CARE to assess the association of genotype with both the risk of incident MI in the placebo arm and the effect of on MI pravastatin compared to placebo in subgroups defined by genotypes. In analyzing the WOSCOPS patients, a conditional logistic regression model was used in WOSCOPS given that the controls had been previously matched to the cases. The column entitled "On-trial MI" lists the number of patients who suffered an RMI during the clinical trial period.

In Table 18, p interaction values were calculated. An interaction (or effect modification) is formed when a third variable modifies the relation between an exposure and outcome. A p interaction <0.05 indicates that a third variable (genotype) modifies the relation between an exposure (statin treatment) and outcome (MI). Genotype and drug interaction is present when the incidence rate of disease in the presence of different genotypes under placebo and statin treatment differs from the incidence rate expected to result from their individual effects. HR stands for Hazard Ratio, which is a concept similar to Odds Ratio (OR). The hazard ratio in survival analysis is the effect of an explanatory variable on the hazard or risk of an event. It describes the likelihood of developing MI based on comparison of event rate between patient treated with pravastatin and placebo. The hCV3054799 risk allele predicted risk of MI in CARE and was associated with odds of CHD in WOSCOPS. In both trials, carriers of this risk allele (about 60% of population) benefited from pravastatin treatment.

Example 2

Other Genetic Polymorphisms Associated with Risk of MI/RMI and Response to Statin Treatment An additional 175 markers were analyzed in samples from the CARE study (secondary MI prevention trial). All patients in CARE had an MI within ten months prior to enrollment in the trial. During the five years of follow-up, 264 patients experienced a recurrent MI (cases) and 2649 patients did not (controls). Of the cases, 150 received placebo treatment and 114 received pravastatin; of the controls, 1290 received placebo and 1359 received pravastatin.

Tables 11-13 show the total counts of case and control samples for each SNP, and a breakdown of cases and controls by genotype: major and minor homozygous individuals, and heterozygous individuals. Table 11 shows the data for the placebo-treatment arm of the study, Table 12, the pravastatin-treatment arm, and Table 13, data for all samples unstratified by treatment.

The genotypes for each SNP were tested for association with RMI. This genotypic test of association (i.e., minor homozygote genotype vs. major, and heterozygote vs. major) was performed separately for placebo-treated patients and for all patients unstratified by treatment group, using the Fisher's exact method. Table 14 shows the odds ratios obtained from the genotypic analysis of the placebo-treatment arm (under the headings "Homozygous Minor" and "Heterozygous Carriers"). The reliability of the OR for each particular SNP is confirmed by its respective 95% confidence interval (CI) and P value, also shown. From Table 14 one can see the association of several SNPs with MI risk when they are present in a Homozygous Minor genotype (association based on an OR>1, the lower limit of the 95% CI>1 and a P value <0.05). These SNPs include but are not limited to: hCV11433557, hCV16054991, hCV25472673, and hCV7514870. In the Heterozygous Carriers genotype, SNPs associated with an increased risk of RMI in Table 14 are: hCV11450617, hCV16189747, hCV25963691, hCV3054799 and hCV465412.

The Dominant and Recessive modes of inheritance for each SNP were also tested for association with MI risk (i.e., Dominant=one or two minor alleles vs. none; Recessive=two minor alleles vs. one or none), in placebo-treated and unstratified sample groups. Table 14 shows modal results for the placebo-treated patients. According to the OR's, P values and confidence intervals listed, all of the SNPs mentioned above as associated with MI risk in Heterozygous Carriers are also associated with increased risk for MI in the Dominant inheritance mode, excepting hCV25963691 and with the addition of hCV1801149 (OR 2.14, P value 0.04). Likewise, all of the SNPs listed above as associated with risk in Homozygous Minor patients are also associated with increased risk for MI in the Recessive inheritance mode.

Table 15 shows results of the genotypic and modal tests of association performed on all patients unstratified by treatment arm; i.e., including statin-treated patients. In this analysis (again according to OR, 95% CI and P value), SNP's significantly associated with MI when present in the Homozygous Minor genotype include: hCV16203383, hCV2146578 and hCV25936375. In the Heterozygous Carriers genotype, MI-risk SNP's include: hCV11450617, hCV16189747, hCV25624196, hCV25963691 and hCV3054799.

The Dominant and Recessive modal results of Table 15 (patients unstratified by treatment arm) indicate that in the Dominant mode, SNP's associated with an increased risk of RMI include: hCV11450617, hCV16189747, hCV25624196, hCV25741584 and hCV3054799. In the Recessive mode, SNP's associated with an increases risk of RMI include: hCV16054991, hCV16203383 and hCV25936375.

The statistical results in Table 16 demonstrate the SNPs predictive of response to statin treatment in the prevention of RMI. All of these SNPs show a significant difference in risk association between their respective placebo- and statin-treated patient groups, as evidenced by Breslow Day P value for each SNP (<0.05). For all SNPs in Table 16, the minor homozygous individuals showed statistically different associations with statin response (OR of placebo vs. pravastatin treatment) when compared to heterozygous and major homozygous individuals. That is, these SNPs, when present in a genotype of one and/or two alleles, are associated with a response to statin treatment such that risk of MI is reduced. Here the Breslow-Day statistics tests whether the odds ratios for MI are different between carriers and non-carriers. A Breslow-Day p value<0.05 means that the association between treatment group and MI is not homogenous across genotypes, therefore, this SNP may be associated with variability in statin response.

As shown in Tables 19 and 20, certain individuals carrying SNPs who were identified in Table 14 as being associated with an increased risk of developing MI/RMI can benefit from being treated with statin because statin reduced their risk of developing MI/RMI, as compared those who did not undergo statin treatment. For example, in the case of hCV11450617, individuals with Heterozygous genotype and the Dominant genotype have their risk of developing MI reduced by statin treatment.

Example 3

Additional SNPS in LD with SNPS that are Associated with Risk of MI/RMI and Response to Statin Treatment An investigation was conducted to identify SNP markers in linkage disequilibrium (LD) with SNPs which have been found to be associated with risk of MI/RMI and response to statin treatment, such as those shown in Tables 1-20. Briefly, the power threshold (T) was set at 51% for detecting disease association using LD markers. This power threshold is based on equation (31) above, which incorporates allele frequency data from previous disease association studies, the predicted error rate for not detecting truly disease-associated markers, and a significance level of 0.05. Using this power calculation and the sample size, for each interrogated SNP a threshold level of LD, or $r^2$ value, was derived ($r_T^2$, equations (32) and (33)). The threshold value $r_T^2$ is the minimum value of linkage disequilibrium between the interrogated SNP and its LD SNPs possible such that the non-interrogated SNP still retains a power greater or equal to T for detecting disease-association.

Based on the methodology described above, LD SNPs were discovered for the interrogated SNPs shown in Tables 5-20. Table 21 shows a listing of some of the LD SNPs, each of which is associated with its respective interrogated SNP. Also shown are the public SNP IDs (rs numbers) for interrogated and LD SNPs, the threshold $r^2$ value and the power used to determine this, and the $r^2$ value of linkage disequilibrium between the interrogated SNP and its matching LD SNP. As an example in Table LD SNP, MI/RMI-associated SNP hCV11450617 was calculated to be in LD with hCV27846382 at an $r^2$ value of 0.73586, based on a 51% power calculation. Thus, hCV27846382 would also be a MI/RMI-associated SNP due to its being in LD with the interrogated SNP hCV11450617.

All publications and patents cited in this specification are herein incorporated by reference in their entirety. Various modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 5

Allelic counts for hCV3054799.

|  |  |  |  |  | Major Allele |  |  | Minor Allele |  |  |
| --- | --- | --- | --- | --- | --- | --- | --- | --- | --- | --- |
| Study | Stratum | All Count | Case Count | Cont Count | Allele | Case Freq | Cont Freq | Allele | Case Freq | Cont Freq |
| CARE | Unstratified | 2714 | 244 | 2470 | A | 0.60 | 0.64 | G | 0.40 | 0.36 |
|  | Placebo | 1334 | 142 | 1192 | A | 0.60 | 0.65 | G | 0.40 | 0.35 |
|  | Pravastatin | 1380 | 102 | 1278 | A | 0.60 | 0.64 | G | 0.40 | 0.36 |
| WOSCOPS | Unstratified | 1548 | 478 | 1070 | A | 0.63 | 0.66 | G | 0.37 | 0.34 |
|  | Placebo | 808 | 286 | 522 | A | 0.62 | 0.69 | G | 0.38 | 0.31 |
|  | Pravastatin | 740 | 192 | 548 | A | 0.65 | 0.63 | G | 0.35 | 0.37 |

TABLE 6

Genotypic counts for hCV3054799.

| | | Major homozygous | | | | | Minor homozygous | | | | | Heterozygous | | | |
|---|---|---|---|---|---|---|---|---|---|---|---|---|---|---|---|
| Study | Genot | Case Count | Cont Count | Case Freq | Cont Freq | Genot | Case Count | Cont Count | Case Freq | Cont Freq | Genot | Case Count | Cont Count | Case Freq | Cont Freq |
| CARE | AA | 82 | 1030 | 0.34 | 0.42 | GG | 35 | 314 | 0.14 | 0.13 | GA | 127 | 1126 | 0.52 | 0.46 |
| | AA | 44 | 502 | 0.31 | 0.42 | GG | 17 | 143 | 0.12 | 0.12 | GA | 81 | 547 | 0.57 | 0.46 |
| | AA | 38 | 528 | 0.37 | 0.41 | GG | 18 | 171 | 0.18 | 0.13 | GA | 46 | 579 | 0.45 | 0.45 |
| WOSCOPS | AA | 189 | 475 | 0.40 | 0.44 | GG | 67 | 132 | 0.14 | 0.12 | GA | 222 | 463 | 0.46 | 0.43 |
| | AA | 105 | 259 | 0.37 | 0.50 | GG | 39 | 58 | 0.14 | 0.11 | GA | 142 | 205 | 0.50 | 0.39 |
| | AA | 84 | 216 | 0.44 | 0.39 | GG | 28 | 74 | 0.15 | 0.14 | GA | 80 | 258 | 0.42 | 0.47 |

TABLE 7

Combined counts for hCV3054799

| | Maj hom + Het | | Het + Min hom | |
|---|---|---|---|---|
| Study | Case Count | Cont Count | Case Count | Cont Count |
| CARE | 209 | 2156 | 162 | 1440 |
| | 125 | 1049 | 98 | 690 |
| | 84 | 1107 | 64 | 750 |
| WOSCOPS | 411 | 938 | 289 | 595 |
| | 247 | 464 | 181 | 263 |
| | 164 | 474 | 108 | 332 |

TABLE 8

Association of genetic polymorphism hCV3054799 with MI/RMI risk - estimates unadjusted.

| | | Heterozygous Carriers (Het vs. Maj hom) | | | Dominant ([Het + Min hom] vs. Maj hom) | | | Recessive (Min hom vs. [Maj hom + Het]) | | | Allelic | | |
|---|---|---|---|---|---|---|---|---|---|---|---|---|---|
| Study | Stratum | OR | 95% CI | P value* | OR | 95% CI | P value* | OR | 95% CI | P value* | OR | 95% CI | P value* |
| CARE | Unstratified | 1.42 | 1.06-1.89 | 0.0201 | 1.41 | 1.07-1.86 | 0.0141 | 1.15 | 0.79-1.68 | 0.4825 | 1.23 | 1.02-1.49 | 0.0336 |
| | Placebo | 1.69 | 1.15-2.49 | 0.0078 | 1.62 | 1.12-2.35 | 0.0114 | 1.00 | 0.58-1.71 | 1.0000 | 1.27 | 0.98-1.63 | 0.0666 |
| | Pravastatin | 1.10 | 0.71-1.72 | 0.7342 | 1.19 | 0.78-1.80 | 0.4647 | 1.39 | 0.81-2.37 | 0.2314 | 1.19 | 0.89-1.60 | 0.2570 |
| WOSCOPS | Unstratified | 1.21 | 0.96-1.52 | 0.1241 | 1.22 | 0.98-1.52 | 0.0756 | 1.16 | 0.84-1.59 | 0.3667 | 1.15 | 0.98-1.35 | 0.0796 |
| | Placebo | 1.71 | 1.25-2.33 | 0.0009 | 1.70 | 1.26-2.28 | 0.0005 | 1.26 | 0.82-1.95 | 0.3091 | 1.41 | 1.14-1.74 | 0.0020 |
| | Pravastatin | 0.80 | 0.56-1.14 | 0.2381 | 0.84 | 0.60-1.17 | 0.3061 | 1.09 | 0.68-1.75 | 0.7159 | 0.93 | 0.73-1.19 | 0.5800 |

*Fisher's exact P value.

TABLE 9

Association of genetic polymorphism hCV3054799 with MI/RMI risk - estimates adjusted by logistic regression.

| Study | Genotype | Risk Freq* | OR** | 95% CI | P value*** |
|---|---|---|---|---|---|
| CARE | Min hom | 0.12 | 1.36 | 0.75-2.44 | 0.321 |
| | Het | 0.47 | 1.69 | 1.14-2.49 | 0.008 |
| WOSCOPS | Min hom | 0.12 | 1.62 | 1.01-2.60 | 0.043 |
| | Het | 0.43 | 1.65 | 1.21-2.25 | 0.002 |

*Chi-square test for frequency of risk genotype.
**Odds ratio derived from patients in Placebo treatment arm.
***Fisher's exact P value.

TABLE 10

Association of genetic polymorphism hCV3054799 with MI/RMI risk and response to statin treatment.

| | MI/RMI risk estimation (Het vs. Maj hom)* | | | Risk Reduction by Statin (Pravastatin vs. Placebo) Heterozygous carriers | | |
|---|---|---|---|---|---|---|
| Study | OR | 95% CI | P value** | OR | 95% CI | P value** |
| CARE | 1.69 | 1.15-2.49 | 0.0078 | 0.54 | 0.36-0.78 | 0.00139 |
| WOSCOPS | 1.71 | 1.25-2.33 | 0.0009 | 0.45 | 0.32-0.62 | 0.0000014 |

*Data also presented in Table 9, Heterozygous carriers.
**Fisher's exact P value.

TABLE 11

Genotypic counts for genetic polymorphisms in CARE study - Placebo arm.

| | | | Major homozygous | | | Minor homozygous | | | Heterozygous | | |
|---|---|---|---|---|---|---|---|---|---|---|---|
| Marker | Case Count | Cont Count | Genotype | Case Count | Cont Count | Genotype | Case Count | Cont Count | Genotype | Case Count | Cont Count |
| hCV11433557 | 102 | 943 | CC | 57 | 592 | GG | 9 | 41 | GC | 36 | 310 |
| hCV11450617 | 145 | 1220 | GG | 61 | 633 | AA | 13 | 101 | AG | 71 | 486 |
| hCV12107274 | 104 | 942 | CC | 54 | 423 | TT | 8 | 122 | TC | 42 | 397 |
| hCV15965459 | 133 | 1157 | TT | 95 | 843 | AA | 1 | 20 | AT | 37 | 294 |
| hCV15973230 | 124 | 1023 | GG | 91 | 657 | AA | 3 | 61 | AG | 30 | 305 |
| hCV15974589 | 101 | 938 | CC | 31 | 238 | TT | 21 | 220 | TC | 49 | 480 |
| hCV16603656 | 104 | 947 | CC | 82 | 818 | TT | 2 | 6 | TC | 20 | 123 |
| hCV16054991 | 132 | 1145 | GG | 60 | 599 | AA | 17 | 81 | AG | 55 | 465 |
| hCV16189747 | 138 | 1174 | CC | 61 | 641 | AA | 9 | 75 | AC | 68 | 458 |
| hCV1801149 | 50 | 403 | GG | 36 | 341 | AA | 1 | 2 | AG | 13 | 60 |
| hCV22275215 | 103 | 947 | CC | 79 | 632 | TT | 2 | 39 | TC | 22 | 276 |
| hCV2476746 | 123 | 1016 | CC | 55 | 405 | TT | 9 | 138 | TC | 59 | 473 |
| hCV25472673 | 104 | 947 | TT | 29 | 338 | CC | 22 | 133 | CT | 53 | 476 |
| hCV25623506 | 104 | 947 | CC | 101 | 894 | TT | 0 | 2 | TC | 3 | 51 |
| hCV25745415 | 145 | 1217 | GG | 91 | 718 | TT | 2 | 63 | TG | 52 | 436 |
| hCV25749177 | 145 | 1217 | GG | 89 | 704 | AA | 4 | 75 | AG | 52 | 438 |
| hCV25963691 | 145 | 1217 | CC | 84 | 793 | GG | 3 | 52 | GC | 58 | 372 |
| hCV2741051 | 104 | 947 | TT | 66 | 494 | CC | 3 | 67 | CT | 35 | 386 |
| hCV3054799 | 104 | 945 | AA | 29 | 398 | GG | 13 | 116 | GA | 62 | 431 |
| hCV465412 | 133 | 1157 | CC | 88 | 881 | AA | 2 | 27 | AC | 43 | 249 |
| hCV7514870 | 103 | 936 | CC | 41 | 436 | AA | 17 | 90 | AC | 45 | 410 |
| hCV881283 | 145 | 1219 | GG | 130 | 1129 | CC | 0 | 2 | CG | 15 | 88 |

TABLE 12

Genotypic counts for genetic polymorphisms in CARE study - Pravastatin treatment arm.

| Marker | Case Count | Cont Count | Genotype | Case Count | Cont Count | Genotype | Case Count | Cont Count | Genotype | Case Count | Cont Count |
|---|---|---|---|---|---|---|---|---|---|---|---|
| hCV12107274 | 84 | 1040 | CC | 34 | 481 | TC | 37 | 446 | TT | 13 | 113 |
| hCV15965459 | 99 | 1231 | TT | 85 | 918 | AT | 13 | 292 | AA | 1 | 21 |
| hCV15974589 | 85 | 1036 | CC | 16 | 286 | TC | 35 | 514 | TT | 34 | 236 |
| hCV16603656 | 85 | 1047 | CC | 76 | 873 | TC | 9 | 166 | TT | 0 | 8 |
| hCV16054991 | 95 | 1216 | GG | 58 | 661 | AG | 29 | 467 | AA | 8 | 88 |
| hCV25472673 | 85 | 1046 | TT | 38 | 392 | CT | 33 | 482 | CC | 14 | 172 |
| hCV25623506 | 85 | 1046 | CC | 72 | 984 | TC | 12 | 62 | TT | 1 | 0 |
| hCV25745415 | 107 | 1302 | GG | 57 | 798 | TG | 39 | 445 | TT | 11 | 59 |
| hCV25749177 | 107 | 1300 | GG | 56 | 776 | AG | 39 | 444 | AA | 12 | 80 |
| hCV2741051 | 85 | 1046 | TT | 39 | 533 | CT | 40 | 433 | CC | 6 | 80 |
| hCV881283 | 107 | 1303 | GG | 103 | 1179 | CG | 4 | 122 | CC | 0 | 2 |

TABLE 13

Genotypic counts for genetic polymorphisms in CARE study - Unstratified by treatment arm.

| Marker | Case Count | Cont Count | Genot | Case Count | Cont Count | Genot | Case Count | Cont Count | Genot | Case Count | Cont Count |
|---|---|---|---|---|---|---|---|---|---|---|---|
| hCV11450617 | 252 | 2523 | AA | 22 | 204 | AG | 120 | 1034 | GG | 110 | 1285 |
| hCV15973230 | 216 | 2135 | AA | 5 | 118 | AG | 62 | 664 | GG | 149 | 1353 |
| hCV16054991 | 227 | 2361 | AA | 25 | 169 | AG | 84 | 932 | GG | 118 | 1260 |
| hCV16189747 | 241 | 2428 | AA | 15 | 153 | AC | 120 | 909 | CC | 106 | 1366 |
| hCV16203383 | 248 | 2513 | TT | 35 | 253 | TC | 114 | 1077 | CC | 99 | 1183 |
| hCV1690777 | 213 | 2104 | GG | 0 | 4 | GA | 7 | 147 | AA | 206 | 1953 |
| hCV2146578 | 215 | 2127 | TT | 49 | 372 | TC | 103 | 1033 | CC | 63 | 722 |
| hCV22275215 | 188 | 1994 | TT | 4 | 76 | TC | 41 | 592 | CC | 143 | 1326 |
| hCV2476746 | 215 | 2117 | TT | 18 | 283 | TC | 96 | 967 | CC | 101 | 867 |
| hCV25624196 | 213 | 2101 | AA | 5 | 52 | AG | 62 | 471 | GG | 146 | 1578 |
| hCV25741584 | 232 | 2390 | CC | 0 | 0 | CG | 8 | 35 | GG | 224 | 2355 |
| hCV25936375 | 233 | 2402 | AA | 12 | 64 | AG | 62 | 649 | GG | 159 | 1689 |
| hCV25963691 | 251 | 2521 | GG | 5 | 100 | GC | 99 | 793 | CC | 147 | 1628 |
| hCV3054799 | 189 | 1990 | GG | 29 | 259 | GA | 100 | 898 | AA | 60 | 833 |
| hCV3200162 | 189 | 1993 | GG | 16 | 234 | GA | 75 | 885 | AA | 98 | 874 |
| hCV945276 | 243 | 2421 | TT | 34 | 459 | TG | 121 | 1181 | GG | 88 | 781 |
| hCV9879153 | 188 | 1992 | TT | 36 | 436 | TC | 85 | 986 | CC | 67 | 570 |

TABLE 14

RMI risk association of genetic polymorphisms in CARE study - Placebo treatment arm.

| Marker | Minor Homozygous (Min hom vs. Maj hom) | | | Heterozygous Carriers (Het vs. Maj hom) | | | Dominant ([Het + Min hom]) vs. Maj hom | | | Recessive Min hom vs. ([Het + Maj hom]) | | |
|---|---|---|---|---|---|---|---|---|---|---|---|---|
| | OR | 95% Cl | P value* | OR | 95% Cl | P value* | OR | 95% Cl | P value* | OR | 95% Cl | P value* |
| hCV11433557 | 2.28 | 1.05-4.93 | 0.0425 | 1.21 | 0.78-1.87 | 0.4242 | 1.33 | 0.88-2.01 | 0.1972 | 2.13 | 1.00-4.52 | 0.0519 |
| hCV11450617 | 1.34 | 0.71-2.52 | 0.3807 | 1.52 | 1.06-2.18 | 0.0262 | 1.48 | 1.05-2.10 | 0.0280 | 1.09 | 0.60-2.00 | 0.7512 |
| hCV15973230 | 0.36 | 0.11-1.16 | 0.0999 | 0.71 | 0.46-1.10 | 0.1437 | 0.65 | 0.43-0.99 | 0.0459 | 0.39 | 0.12-1.27 | 0.1437 |
| hCV16054991 | 2.10 | 1.17-3.77 | 0.0186 | 1.18 | 0.80-1.74 | 0.4295 | 1.32 | 0.92-1.89 | 0.1419 | 1.94 | 1.11-3.39 | 0.0240 |
| hCV16189747 | 1.26 | 0.60-2.64 | 0.5424 | 1.56 | 1.08-2.25 | 0.0186 | 1.52 | 1.06-2.17 | 0.0239 | 1.02 | 0.50-2.09 | 0.8559 |
| hCV1801149 | 4.74 | 0.42-53.53 | 0.2652 | 2.05 | 1.03-4.10 | 0.0616 | 2.14 | 1.09-4.20 | 0.0422 | 4.09 | 0.36-45.96 | 0.2965 |
| hCV22275215 | 0.41 | 0.10-1.73 | 0.3005 | 0.64 | 0.39-1.04 | 0.0842 | 0.61 | 0.38-0.98 | 0.0454 | 0.46 | 0.11-1.94 | 0.4208 |
| hCV2476746 | 0.48 | 0.23-1.00 | 0.0456 | 0.92 | 0.62-1.36 | 0.6905 | 0.82 | 0.56-1.19 | 0.3307 | 0.50 | 0.25-1.01 | 0.0627 |
| hCV25472673 | 1.93 | 1.07-3.48 | 0.0352 | 1.30 | 0.81-2.08 | 0.2918 | 1.44 | 0.92-2.25 | 0.1292 | 1.64 | 0.99-2.72 | 0.0584 |
| hCV25745415 | 0.25 | 0.06-1.04 | 0.0362 | 0.94 | 0.66-1.35 | 0.7841 | 0.85 | 0.60-1.22 | 0.4211 | 0.26 | 0.06-1.06 | 0.0389 |
| hCV25963691 | 0.54 | 0.17-1.78 | 0.4709 | 1.47 | 1.03-2.10 | 0.0373 | 1.36 | 0.96-1.93 | 0.0984 | 0.47 | 0.15-1.54 | 0.2657 |
| hCV2741051 | 0.34 | 0.10-1.10 | 0.0664 | 0.68 | 0.44-1.04 | 0.0892 | 0.63 | 0.41-0.95 | 0.0299 | 0.39 | 0.12-1.26 | 0.1435 |
| hCV3054799 | 1.54 | 0.77-3.05 | 0.2528 | 1.97 | 1.24-3.13 | 0.0038 | 1.88 | 1.20-2.94 | 0.0060 | 1.02 | 0.55-1.88 | 0.8762 |
| hCV465412 | 0.74 | 0.17-3.17 | 1.0000 | 1.73 | 1.17-2.56 | 0.0083 | 1.63 | 1.11-2.40 | 0.0147 | 0.64 | 0.15-2.72 | 0.7608 |
| hCV7514870 | 2.01 | 1.09-3.69 | 0.0308 | 1.17 | 0.75-1.82 | 0.4996 | 1.32 | 0.87-2.00 | 0.2117 | 1.86 | 1.06-3.27 | 0.0389 |

For hCV15973230, hCV22275215 and hCV2741051, major homozygotes were associated with RMI using heterozygotes and minor homozygotes as reference.
For hCV2476746 and hCV25745415, major homozygotes were associated with RMI using minor homozygotes as reference.

TABLE 15

RMI risk association of genetic polymorphisms in CARE study - Unstratified by treatment arm.

| Marker | Minor Homozygous (Min hom vs. Maj hom) | | | Heterozygous carriers (Het vs. Maj hom) | | | Dominant ([Het + Min hom]) vs. Maj hom | | | Recessive Min hom vs. ([Het + Maj hom]) | | |
|---|---|---|---|---|---|---|---|---|---|---|---|---|
| | OR | 95% Cl | P value* | OR | 95% Cl | P value* | OR | 95% Cl | P value* | OR | 95% Cl | P value* |
| hCV11450617 | 1.26 | 0.78-2.04 | 0.3583 | 1.36 | 1.03-1.78 | 0.0312 | 1.34 | 1.03-1.74 | 0.0292 | 1.09 | 0.69-1.72 | 0.7169 |
| hCV15973230 | 0.38 | 0.15-0.96 | 0.0357 | 0.85 | 0.62-1.16 | 0.3162 | 0.78 | 0.58-1.05 | 0.1183 | 0.41 | 0.16-1.00 | 0.0520 |
| hCV16054991 | 1.58 | 1.00-2.50 | 0.0609 | 0.96 | 0.72-1.29 | 0.8237 | 1.06 | 0.80-1.39 | 0.7278 | 1.61 | 1.03-2.50 | 0.0464 |
| hCV16189747 | 1.26 | 0.72-2.22 | 0.4347 | 1.70 | 1.29-2.24 | 0.0002 | 1.64 | 1.25-2.14 | 0.0003 | 0.99 | 0.57-1.71 | 1.0000 |
| hCV16203383 | 1.65 | 1.10-2.49 | 0.0192 | 1.26 | 0.95-1.68 | 0.1144 | 1.34 | 1.03-1.75 | 0.0327 | 1.47 | 1.00-2.15 | 0.0502 |
| hCV1690777 | 0.00 | 0.00-0.00 | 1.0000 | 0.45 | 0.21-0.98 | 0.0420 | 0.44 | 0.20-0.95 | 0.0314 | 0.00 | 0.00-0.00 | 1.0000 |
| hCV2146578 | 1.51 | 1.02-2.24 | 0.0476 | 1.14 | 0.82-1.59 | 0.4577 | 1.24 | 0.91-1.69 | 0.1734 | 1.39 | 0.99-1.95 | 0.0619 |
| hCV22275215 | 0.49 | 0.18-1.35 | 0.2361 | 0.64 | 0.45-0.92 | 0.0147 | 0.62 | 0.44-0.88 | 0.0072 | 0.55 | 0.20-1.52 | 0.3109 |
| hCV2476746 | 0.55 | 0.32-0.92 | 0.0230 | 0.85 | 0.64-1.14 | 0.2941 | 0.78 | 0.59-1.04 | 0.0948 | 0.59 | 0.36-0.97 | 0.0418 |
| hCV25624196 | 1.04 | 0.41-2.64 | 0.8114 | 1.42 | 1.04-1.95 | 0.0320 | 1.38 | 1.02-1.88 | 0.0392 | 0.95 | 0.37-2.40 | 1.0000 |
| hCV25741584 | 0.00 | 0.00-0.00 | 1.0000 | 2.40 | 1.10-5.24 | 0.0498 | 2.40 | 1.10-5.24 | 0.0498 | 0.00 | 0.00-0.00 | 1.0000 |
| hCV25936375 | 1.99 | 1.05-3.76 | 0.0390 | 1.01 | 0.75-1.38 | 0.9374 | 1.10 | 0.83-1.47 | 0.5008 | 1.98 | 1.05-3.73 | 0.0391 |
| hCV25963691 | 0.55 | 0.22-1.38 | 0.2671 | 1.38 | 1.06-1.81 | 0.0193 | 1.29 | 0.99-1.68 | 0.0626 | 0.49 | 0.20-1.22 | 0.1623 |
| hCV3054799 | 1.55 | 0.98-2.47 | 0.0718 | 1.55 | 1.11-2.16 | 0.0103 | 1.55 | 1.13-2.13 | 0.0067 | 1.21 | 0.80-1.84 | 0.3687 |
| hCV3200162 | 0.61 | 0.35-1.05 | 0.0872 | 0.76 | 0.55-1.04 | 0.0940 | 0.73 | 0.54-0.98 | 0.0386 | 0.70 | 0.41-1.18 | 0.1904 |
| hCV945276 | 0.66 | 0.44-0.99 | 0.0483 | 0.91 | 0.68-1.21 | 0.5526 | 0.84 | 0.64-1.10 | 0.2225 | 0.70 | 0.48-1.01 | 0.0570 |
| hCV9879153 | 0.70 | 0.46-1.07 | 0.1164 | 0.73 | 0.52-1.03 | 0.0787 | 0.72 | 0.53-0.99 | 0.0445 | 0.85 | 0.58-1.23 | 0.4061 |

TABLE 16

Association of genetic polymorphisms with response to statin treatment in CARE study.
Risk of RMI in placebo- vs. pravastatin-treated patients.

| Marker | Major homozygous | | | Minor homozygous | | | Heterozygous | | | BD P value** |
|---|---|---|---|---|---|---|---|---|---|---|
| | OR | 95% Cl | P value* | OR | 95% Cl | P value* | OR | 95% Cl | P value* | |
| hCV12107274 | 0.55 | 0.35-0.87 | 0.0100 | 1.75 | 0.70-4.39 | 0.2598 | 0.78 | 0.49-1.24 | 0.3462 | 0.0255 |
| hCV15965459 | 0.82 | 0.60-1.12 | 0.2115 | 0.95 | 0.06-16.28 | 1.0000 | 0.35 | 0.18-0.68 | 0.0011 | 0.0408 |
| hCV15974589 | 0.43 | 0.23-0.80 | 0.0090 | 1.51 | 0.85-2.68 | 0.1979 | 0.67 | 0.42-1.05 | 0.0881 | 0.0018 |
| hCV1603656 | 0.87 | 0.63-1.20 | 0.4064 | 0.00 | 0.00-0.00 | 0.4667 | 0.33 | 0.15-0.76 | 0.0099 | 0.0097 |
| hCV16054991 | 0.88 | 0.60-1.28 | 0.5015 | 0.43 | 0.18-1.06 | 0.0854 | 0.53 | 0.33-0.84 | 0.0063 | 0.0463 |
| hCV25472673 | 1.13 | 0.68-1.87 | 0.7014 | 0.49 | 0.24-1.00 | 0.0524 | 0.61 | 0.39-0.97 | 0.0422 | 0.0382 |
| hCV25623506 | 0.65 | 0.47-0.89 | 0.0069 | 0.00 | 0.00-0.00 | 0.3333 | 3.29 | 0.88-12.30 | 0.0939 | 0.0035 |
| hCV25745415 | 0.56 | 0.40-0.80 | 0.0010 | 5.87 | 1.25-27.61 | 0.0176 | 0.73 | 0.48-1.14 | 0.1865 | 0.0073 |
| hCV25749177 | 0.57 | 0.40-0.81 | 0.0017 | 2.81 | 0.87-9.10 | 0.1124 | 0.74 | 0.48-1.14 | 0.1873 | 0.0169 |
| hCV2741051 | 0.55 | 0.36-0.83 | 0.0041 | 1.68 | 0.40-6.95 | 0.7321 | 1.02 | 0.63-1.64 | 1.0000 | 0.0307 |
| hCV881283 | 0.76 | 0.58-0.99 | 0.0464 | 0.00 | 0.00-0.00 | 1.0000 | 0.19 | 0.06-0.60 | 0.0029 | 0.0185 |

*Fisher's exact P value.
**Breslow-Day P value.

TABLE 17

Association of KIF6 hCV3054799 with MI and CHD in the placebo arm of CARE and WOSCOPS

| Study | Genotype | On-trial MI* | Total* | Unadjusted | | | Adjusted[†] | | |
|---|---|---|---|---|---|---|---|---|---|
| | | | | HR | 95% Cl | p Value | HR | 95% Cl | p Value |
| CARE | GG | 16 | 155 | 1.33 | 0.75-2.35 | 0.33 | 1.33 | 0.75-2.36 | 0.33 |
| | GA | 82 | 636 | 1.63 | 1.13-2.35 | 0.009 | 1.54 | 1.07-2.23 | 0.02 |
| | GG + GA | 98 | 791 | 1.57 | 1.10-2.25 | 0.013 | 1.50 | 1.05-2.15 | 0.03 |
| | AA | 44 | 542 | 1.00 | ref | | 1.00 | ref | |

| Study | Genotype | Case* | Control* | Matched[‡] | | | Adjusted[†‡] | | |
|---|---|---|---|---|---|---|---|---|---|
| | | | | OR | 95% Cl | p Value | OR | 95% Cl | p Value |
| WOSCOPS | GG | 35 | 59 | 1.49 | 0.92-2.40 | 0.10 | 1.48 | 0.91-2.41 | 0.11 |
| | GA | 137 | 204 | 1.61 | 1.18-2.21 | 0.003 | 1.56 | 1.14-2.15 | 0.006 |
| | GG + GA | 172 | 263 | 1.59 | 1.18-2.14 | 0.003 | 1.55 | 1.14-2.09 | 0.005 |
| | AA | 104 | 256 | 1.00 | ref | | 1.00 | ref | |

*Data for patients presented as number of patients
[†]Adjusted for age (continuous), sex, smoking (current versus non-current) (except in WOSCOPS, where no adjustments for age and smoking were made because cases and controls were matched), history of hypertension, history of diabetes, BMI (continuous), baseline LDL-C level (continuous), and baseline HDL-C level (continuous).
[‡]Cases and controls were matched for age (in two-year age groups) and smoking (current versus non-current), all were men.

TABLE 18

Effect of pravastatin on MI and CHD in KIF6 hCV3054799 subgroups: CARE and WOSCOPS

| Study | Genotype | Treatment | On-trial MI* | Total* | Unadjusted | | | Adjusted[†] | | |
|---|---|---|---|---|---|---|---|---|---|---|
| | | | | | HR | 95% CI | p Value | HR | 95% CI | p Value |
| CARE | GG + GA | Pravastatin | 64 | 810 | 0.63 | 0.46-0.86 | 0.004 | 0.63 | 0.46-0.87 | 0.005 |
| | | Placebo | 98 | 791 | 1.00 | ref | | 1.00 | ref | |
| | AA | Pravastatin | 39 | 554 | 0.86 | 0.56-1.33 | 0.50 | 0.80 | 0.52-1.24 | 0.32 |
| | | Placebo | 44 | 542 | 1.00 | ref | | 1.00 | ref | |
| | | | | | | | p interaction 0.25[§] | | | p interaction 0.39[§] |

| Study | Genotype | Treatment | Case* | Control* | Matched[‡] | | | Adjusted[†‡] | | |
|---|---|---|---|---|---|---|---|---|---|---|
| | | | | | OR[†] | 95% CI[†] | p Value | OR[†] | 95% CI | p Value |
| WOSCOPS | GG + GA | Pravastatin | 108 | 330 | 0.50 | 0.38-0.67 | <0.0001 | 0.50 | 0.38-0.67 | <0.0001 |
| | | Placebo | 172 | 263 | 1.00 | ref | | 1.00 | ref | |
| | AA | Pravastatin | 81 | 213 | 0.94 | 0.67-1.33 | 0.73 | 0.91 | 0.64-1.28 | 0.58 |
| | | Placebo | 104 | 256 | 1.00 | ref | | 1.00 | ref | |
| | | | | | | | p interaction 0.006[§] | | | p interaction 0.011[§] |

*Data for patients presented as number of patients
[†]Adjusted for age (continuous), smoking (current versus non-current) (except in WOSCOPS, where no adjustment for age and smoking were made because cases and controls were matched), history of hypertension, history of diabetes, BMI (continuous), baseline LDL-C level (continuous), and baseline HDL-C level (continuous).
[‡]Cases and controls were matched for age (in two-year age groups) and smoking (current versus non-current), all were men.
[§]Likelihood ratio test of interaction between KIF6 hCV3054799 genotype and treatment.

TABLE 19

Genotypic counts for genetic polymorphisms in CARE study - Placebo arm and statin arm

| Marker | Treatment | Genot | case cnt | control cnt | Genot | case cnt | control cnt | Genot | case cnt | control cnt |
|---|---|---|---|---|---|---|---|---|---|---|
| hCV11450617 | placebo | AA | 13 | 101 | AG | 71 | 486 | GG | 61 | 633 |
| hCV11450617 | statin | AA | 9 | 103 | AG | 49 | 548 | GG | 49 | 652 |
| hCV15973230 | placebo | AA | 3 | 61 | AG | 30 | 305 | GG | 91 | 657 |
| hCV15973230 | statin | AA | 2 | 57 | AG | 32 | 359 | GG | 58 | 696 |
| hCV25745415 | placebo | TT | 2 | 63 | TG | 52 | 436 | GG | 91 | 718 |
| hCV25745415 | statin | TT | 11 | 59 | TG | 39 | 445 | GG | 57 | 798 |
| hCV25963691 | placebo | GG | 3 | 52 | GC | 58 | 372 | CC | 84 | 793 |
| hCV25963691 | statin | GG | 2 | 48 | GC | 41 | 421 | CC | 63 | 835 |
| hCV2741051 | placebo | CC | 3 | 67 | CT | 35 | 386 | TT | 66 | 494 |
| hCV2741051 | statin | CC | 6 | 80 | CT | 40 | 433 | TT | 39 | 533 |
| hCV3054799 | placebo | GG | 13 | 116 | GA | 62 | 431 | AA | 29 | 398 |
| hCV3054799 | statin | GG | 16 | 143 | GA | 38 | 467 | AA | 31 | 435 |
| hCV465412 | placebo | AA | 2 | 27 | AC | 43 | 249 | CC | 88 | 881 |
| hCV465412 | statin | AA | 2 | 20 | AC | 24 | 298 | CC | 73 | 910 |
| hCV7514870 | placebo | AA | 17 | 90 | AC | 45 | 410 | CC | 41 | 436 |
| hCV7514870 | statin | AA | 9 | 130 | AC | 40 | 439 | CC | 35 | 466 |

TABLE 20

Risk reduction by pravastatin in CARE patients stratified by genotypes of the SNPs associated with MI (table 14)
Risk of RMI in placebo- vs. pravastatin-treated patients.

| | Minor Homozygous | | | Heterozygous | | | Major Homozygous | | | Dominant | | |
|---|---|---|---|---|---|---|---|---|---|---|---|---|
| Marker | OR_min | 95% CI | P value* | OR_het | 95% CI | P value* | OR_maj | 95% CI | P value* | OR_dom | 95% CI | P value* |
| hCV11450617 hCV11450617 | 0.68 | 0.28-1.66 | 0.502 | 0.61 | 0.42-0.9 | 0.012 | 0.78 | 0.53-1.16 | 0.234 | 0.62 | 0.44-0.89 | 0.010 |
| hCV15973230 hCV15973230 | 0.71 | 0.12-4.43 | 1.000 | 0.91 | 0.54-1.53 | 0.790 | 0.60 | 0.43-0.86 | 0.004 | 0.91 | 0.56-1.5 | 0.704 |
| hCV25745415 hCV25745415 | 5.87 | 1.25-27.62 | 0.018 | 0.73 | 0.48-1.14 | 0.187 | 0.56 | 0.4-0.8 | 0.001 | 0.92 | 0.62-1.38 | 0.682 |
| hCV25963691 hCV25963691 | 0.72 | 0.12-4.52 | 1.000 | 0.62 | 0.41-0.96 | 0.033 | 0.71 | 0.51-1.01 | 0.058 | 0.64 | 0.43-0.97 | 0.038 |
| hCV2741051 hCV2741051 | 1.68 | 0.41-6.96 | 0.732 | 1.02 | 0.64-1.64 | 1.000 | 0.55 | 0.37-0.83 | 0.004 | 1.07 | 0.69-1.68 | 0.820 |
| hCV3054799 hCV3054799 | 1.00 | 0.47-2.17 | 1.000 | 0.57 | 0.37-0.87 | 0.008 | 0.98 | 0.58-1.66 | 1.000 | 0.65 | 0.45-0.94 | 0.020 |
| hCV465412 hCV465412 | 1.35 | 0.18-10.42 | 1.000 | 0.47 | 0.28-0.79 | 0.004 | 0.80 | 0.59-1.12 | 0.189 | 0.50 | 0.31-0.84 | 0.008 |
| hCV7514870 hCV7514870 | 0.37 | 0.16-0.86 | 0.021 | 0.83 | 0.54-1.3 | 0.428 | 0.80 | 0.5-1.28 | 0.403 | 0.69 | 0.47-1.03 | 0.073 |

*Fisher's exact P value.

TABLE 21

LD SNPs associated with MI/RMI risks and statin response

| Interrogated SNP | Interrogated SNP RS | LD SNP | LD SNP RS | Power | Threshold $r_T^2$ | $r^2$ |
|---|---|---|---|---|---|---|
| hCV11450617 | rs1944270 | hCV27846382 | rs7234924 | 0.51 | 0.58 | 0.73586 |
| hCV15973230 | rs2304024 | hCV25639371 | rs3734051 | 0.51 | 0.39 | 0.60534 |
| hCV15973230 | rs2304024 | hCV25951598 | rs3734049 | 0.51 | 0.39 | 0.8599 |
| hCV15973230 | rs2304024 | hCV25953895 | rs3734047 | 0.51 | 0.39 | 0.86466 |
| hCV15973230 | rs2304024 | hCV31985917 | rs6870052 | 0.51 | 0.39 | 0.86466 |
| hCV15974589 | rs4875 | hCV11238304 | rs8455 | 0.51 | 0.93 | 0.9329 |
| hCV15974589 | rs4875 | hCV2004219 | rs891464 | 0.51 | 0.93 | 1 |
| hCV15974589 | rs4875 | hCV29114176 | rs6804259 | 0.51 | 0.93 | 0.96148 |
| hCV15974589 | rs4875 | hCV29114183 | rs7621897 | 0.51 | 0.93 | 1 |
| hCV15974589 | rs4875 | hCV29114184 | rs6772483 | 0.51 | 0.93 | 1 |
| hCV15974589 | rs4875 | hCV29593475 | rs9819567 | 0.51 | 0.93 | 1 |
| hCV15974589 | rs4875 | hCV29864539 | rs6803047 | 0.51 | 0.93 | 1 |
| hCV15974589 | rs4875 | hCV3175476 | rs6800914 | 0.51 | 0.93 | 0.96448 |
| hCV16189747 | rs2298566 | hCV1067003 | rs735094 | 0.51 | 0.24 | 0.32038 |
| hCV16189747 | rs2298566 | hCV11345437 | rs7937411 | 0.51 | 0.24 | 0.86498 |
| hCV16189747 | rs2298566 | hCV11345444 | rs7937166 | 0.51 | 0.24 | 0.84361 |
| hCV16189747 | rs2298566 | hCV25626063 | rs3751039 | 0.51 | 0.24 | 0.3836 |
| hCV16189747 | rs2298566 | hCV25626077 | rs4414223 | 0.51 | 0.24 | 0.86498 |
| hCV16189747 | rs2298566 | hCV25626089 | rs4586174 | 0.51 | 0.24 | 0.9631 |
| hCV16189747 | rs2298566 | hCV25626101 | rs6590537 | 0.51 | 0.24 | 0.84541 |
| hCV16189747 | rs2298566 | hCV25759522 | rs3751037 | 0.51 | 0.24 | 0.96383 |
| hCV16189747 | rs2298566 | hCV25767057 | rs12421950 | 0.51 | 0.24 | 0.24257 |
| hCV16189747 | rs2298566 | hCV26490015 | rs7942621 | 0.51 | 0.24 | 0.41952 |
| hCV16189747 | rs2298566 | hCV26490026 | rs7924461 | 0.51 | 0.24 | 0.86498 |
| hCV16189747 | rs2298566 | hCV26490027 | rs7937782 | 0.51 | 0.24 | 0.86498 |
| hCV16189747 | rs2298566 | hCV26490028 | rs7924736 | 0.51 | 0.24 | 0.86498 |
| hCV16189747 | rs2298566 | hCV26490038 | rs6590523 | 0.51 | 0.24 | 0.85859 |
| hCV16189747 | rs2298566 | hCV26490043 | rs6421609 | 0.51 | 0.24 | 0.86498 |
| hCV16189747 | rs2298566 | hCV26490055 | rs3794143 | 0.51 | 0.24 | 0.86498 |
| hCV16189747 | rs2298566 | hCV26490056 | rs3794140 | 0.51 | 0.24 | 0.67868 |
| hCV16189747 | rs2298566 | hCV26490057 | rs7925664 | 0.51 | 0.24 | 0.86498 |
| hCV16189747 | rs2298566 | hCV26490064 | rs3829270 | 0.51 | 0.24 | 0.86498 |
| hCV16189747 | rs2298566 | hCV26490066 | rs3794132 | 0.51 | 0.24 | 0.89643 |
| hCV16189747 | rs2298566 | hCV26490121 | rs2875322 | 0.51 | 0.24 | 0.47739 |
| hCV16189747 | rs2298566 | hCV27467549 | rs3190331 | 0.51 | 0.24 | 0.41054 |
| hCV16189747 | rs2298566 | hCV27497392 | rs3829271 | 0.51 | 0.24 | 0.34599 |
| hCV16189747 | rs2298566 | hCV27502173 | rs3794139 | 0.51 | 0.24 | 0.86498 |
| hCV16189747 | rs2298566 | hCV27868997 | rs4622274 | 0.51 | 0.24 | 0.29087 |
| hCV16189747 | rs2298566 | hCV27868998 | rs4936121 | 0.51 | 0.24 | 0.38654 |
| hCV16189747 | rs2298566 | hCV27869000 | rs4436551 | 0.51 | 0.24 | 0.41054 |
| hCV16189747 | rs2298566 | hCV27869001 | rs4264159 | 0.51 | 0.24 | 0.40152 |
| hCV16189747 | rs2298566 | hCV27931232 | rs4456262 | 0.51 | 0.24 | 0.41054 |
| hCV16189747 | rs2298566 | hCV27996234 | rs4457753 | 0.51 | 0.24 | 0.41296 |
| hCV16189747 | rs2298566 | hCV29138817 | rs4936120 | 0.51 | 0.24 | 0.31397 |

TABLE 21-continued

LD SNPs associated with MI/RMI risks and statin response

| Interrogated SNP | Interrogated SNP RS | LD SNP | LD SNP RS | Power | Threshold $r_T^2$ | $r^2$ |
|---|---|---|---|---|---|---|
| hCV16189747 | rs2298566 | hCV29138819 | rs7116068 | 0.51 | 0.24 | 0.36418 |
| hCV16189747 | rs2298566 | hCV29138820 | rs7119425 | 0.51 | 0.24 | 0.39687 |
| hCV16189747 | rs2298566 | hCV29138822 | rs6590518 | 0.51 | 0.24 | 0.39687 |
| hCV16189747 | rs2298566 | hCV29138826 | rs4936123 | 0.51 | 0.24 | 0.41054 |
| hCV16189747 | rs2298566 | hCV29138827 | rs6590520 | 0.51 | 0.24 | 0.40531 |
| hCV16189747 | rs2298566 | hCV29138833 | rs6590532 | 0.51 | 0.24 | 0.75456 |
| hCV16189747 | rs2298566 | hCV29138834 | rs6590533 | 0.51 | 0.24 | 0.84765 |
| hCV16189747 | rs2298566 | hCV29138837 | rs7110968 | 0.51 | 0.24 | 0.86498 |
| hCV16189747 | rs2298566 | hCV29138841 | rs7933747 | 0.51 | 0.24 | 0.84826 |
| hCV16189747 | rs2298566 | hCV29138842 | rs7933767 | 0.51 | 0.24 | 0.86378 |
| hCV16189747 | rs2298566 | hCV29138843 | rs7930661 | 0.51 | 0.24 | 0.86498 |
| hCV16189747 | rs2298566 | hCV29138844 | rs7943935 | 0.51 | 0.24 | 0.86498 |
| hCV16189747 | rs2298566 | hCV29138848 | rs7110591 | 0.51 | 0.24 | 0.86498 |
| hCV16189747 | rs2298566 | hCV29138854 | rs7949722 | 0.51 | 0.24 | 0.85299 |
| hCV16189747 | rs2298566 | hCV3108695 | rs4937582 | 0.51 | 0.24 | 1 |
| hCV16189747 | rs2298566 | hCV3108709 | rs948085 | 0.51 | 0.24 | 1 |
| hCV16189747 | rs2298566 | hCV3108767 | rs3198419 | 0.51 | 0.24 | 0.86498 |
| hCV16189747 | rs2298566 | hCV31258077 | rs6590515 | 0.51 | 0.24 | 0.39687 |
| hCV16189747 | rs2298566 | hCV31258078 | rs6590517 | 0.51 | 0.24 | 0.39687 |
| hCV16189747 | rs2298566 | hCV31258101 | rs4459316 | 0.51 | 0.24 | 0.41952 |
| hCV16189747 | rs2298566 | hCV31258105 | rs7106973 | 0.51 | 0.24 | 0.36538 |
| hCV16189747 | rs2298566 | hCV31258108 | rs7107595 | 0.51 | 0.24 | 0.41054 |
| hCV16189747 | rs2298566 | hCV31258111 | rs7937514 | 0.51 | 0.24 | 0.86498 |
| hCV16189747 | rs2298566 | hCV31258124 | rs3794136 | 0.51 | 0.24 | 0.86252 |
| hCV16189747 | rs2298566 | hCV3251044 | rs7114655 | 0.51 | 0.24 | 0.3931 |
| hCV16189747 | rs2298566 | hCV3251060 | rs7943757 | 0.51 | 0.24 | 0.29892 |
| hCV16189747 | rs2298566 | hCV3251061 | rs4366492 | 0.51 | 0.24 | 0.43166 |
| hCV16189747 | rs2298566 | hCV3251063 | rs6590512 | 0.51 | 0.24 | 0.3731 |
| hCV16189747 | rs2298566 | hCV3251074 | rs7106373 | 0.51 | 0.24 | 0.96341 |
| hCV16189747 | rs2298566 | hCV3251078 | rs4601795 | 0.51 | 0.24 | 0.42463 |
| hCV16189747 | rs2298566 | hDV71141362 | rs876641 | 0.51 | 0.24 | 0.40253 |
| hCV16189747 | rs2298566 | hDV71218734 | rs7110949 | 0.51 | 0.24 | 0.86498 |
| hCV1801149 | rs4750685 | hCV11276365 | rs4750935 | 0.51 | 0.73 | 0.88081 |
| hCV1801149 | rs4750685 | hCV1801142 | rs9787436 | 0.51 | 0.73 | 1 |
| hCV1801149 | rs4750685 | hCV1801143 | rs7100645 | 0.51 | 0.73 | 1 |
| hCV1801149 | rs4750685 | hCV1801150 | rs7918199 | 0.51 | 0.73 | 1 |
| hCV1801149 | rs4750685 | hCV1801168 | rs3781301 | 0.51 | 0.73 | 0.88095 |
| hCV1801149 | rs4750685 | hCV218623 | rs12261926 | 0.51 | 0.73 | 0.75008 |
| hCV1801149 | rs4750685 | hCV31968274 | rs11016063 | 0.51 | 0.73 | 0.75008 |
| hCV1801149 | rs4750685 | hCV31968275 | rs11016062 | 0.51 | 0.73 | 0.74272 |
| hCV1801149 | rs4750685 | hCV374877 | rs12252890 | 0.51 | 0.73 | 0.75008 |
| hCV1801149 | rs4750685 | hCV8903188 | rs997983 | 0.51 | 0.73 | 1 |
| hCV22275215 | rs3826543 | hCV25610955 | rs7221716 | 0.51 | 0.24 | 0.64584 |
| hCV22275215 | rs3826543 | hCV25610955 | rs7221716 | 0.51 | 0.560671413 | 0.64584 |
| hCV22275215 | rs3826543 | hCV26960050 | rs7221547 | 0.51 | 0.24 | 0.64511 |
| hCV22275215 | rs3826543 | hCV26960050 | rs7221547 | 0.51 | 0.560671413 | 0.64511 |
| hCV22275215 | rs3826543 | hCV27915850 | rs4792722 | 0.51 | 0.24 | 0.50871 |
| hCV22275215 | rs3826543 | hCV29573094 | rs8079361 | 0.51 | 0.24 | 0.4 |
| hCV22275215 | rs3826543 | hCV30294410 | rs9899432 | 0.51 | 0.24 | 0.61158 |
| hCV22275215 | rs3826543 | hCV30294410 | rs9899432 | 0.51 | 0.560671413 | 0.61158 |
| hCV22275215 | rs3826543 | hCV30957093 | rs7225429 | 0.51 | 0.24 | 0.81833 |
| hCV22275215 | rs3826543 | hCV30957093 | rs7225429 | 0.51 | 0.560671413 | 0.81833 |
| hCV22275215 | rs3826543 | hCV30957101 | rs6503096 | 0.51 | 0.24 | 0.81833 |
| hCV22275215 | rs3826543 | hCV30957101 | rs6503096 | 0.51 | 0.560671413 | 0.81833 |
| hCV22275215 | rs3826543 | hCV30957112 | rs7208297 | 0.51 | 0.24 | 0.48325 |
| hCV22275215 | rs3826543 | hCV31793593 | rs4792590 | 0.51 | 0.24 | 0.59064 |
| hCV22275215 | rs3826543 | hCV31793593 | rs4792590 | 0.51 | 0.560671413 | 0.59064 |
| hCV22275215 | rs3826543 | hCV7453127 | rs8531 | 0.51 | 0.24 | 0.25349 |
| hCV22275215 | rs3826543 | hDV71102112 | rs869773 | 0.51 | 0.24 | 0.26288 |
| hCV3200162 | rs10455 | hCV27053832 | rs2542939 | 0.51 | 0.67 | 0.95761 |
| hCV3200162 | rs10455 | hCV31898499 | rs11675373 | 0.51 | 0.67 | 0.95787 |
| hCV3200162 | rs10455 | hCV3200161 | rs2542941 | 0.51 | 0.67 | 1 |
| hCV3200162 | rs10455 | hDV71152540 | rs950163 | 0.51 | 0.67 | 1 |

SEQUENCE LISTING (410 sequences)

SEQ ID NO: 1 - DNA, 2367 bp, Homo Sapian
agacacaaaatcagccagggggagcccacattggagggcagtccacaatggaaggcttcttggaggaggagatgattgagctgcttctactaagatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtgagcctcacccgcttaacggacggggagaatgtggtggtttcagagttcacgtccaaggaggagctcattgaggccctatactgcagctgcttcgtcccggtgtactgtggcctcatccccccgacttaccgcggtgtgaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgaatgctgtttatcttaattcttcctccaagagagtgattttcccccgggtggaagtgtactgccagatagaactcgcccttggcaatgagtgccctgaacgcagtcaaccaagccttcgagcacggcaggccagtctggaaggagccacacaacctcacaaggagtgggttcccaaaggggatggaaggggcagccatggtccgcctgtgtcccaacctgtgcagacacttgaattcacatgcgagtcacctgtttcagcaccagtctctccacttgagcagccacctgcacagccactggcctcttcaactccactttctctaagtggcatgccacctgtatcattcccagctgtgcacaagccacccagctccacacctggttcatcactgcccaccccaccacctggactgtcacctctgtcacctcagcagcaggtacaaccgtctggatcaccagccagatccctacactctcaggcacccacttcacccaggccatccctggggccttcaactgtgggggcacctcaaacactgccccgaagttctctttcagccttccctgctcagccacctgtggaggaactaggccaagaacagccccaagctgtagctcttcttgtctcttcaaaaccaaaaagcgccgtgcctctggttcatgtgaaggaaaccgtcagcaagccttatgtaatggagagccctgctgaagactcaaactgggtgaataaggtcttcaagaagaacaagcaaaagacaagtggcaccagaaaaggcttcccaagacattcgggatccaaaaaaccaagcagcaaagtgcagtgagcatgtctaatgttccttaaatcccacggagaggagcagctttgggaactgtgttcagagagattccgaggaatagaggagagtgtaagggagtagggggtgcagtgggagattgggctttggaacagacacatccgacataaaattcctgctctgccacagctccactcagggatcatggttgggacacttgctctccctgagcctccatttcctgtaaaatggggatgataccacttcataaagttgtgagagttaaatgtgatcgatgatgtaaattgcttcatagaatgcagaatgtgtaatagctcacaataagtaggtattatgtttacatattatgtttgtatttatgctacttaaatacaaaactggacaggccaggcatggtggctcatgcctgtaatcccagcactttgggaggctgaggtaggtggaaaacctgaggtcaggagttcaagaacagcctgaccaacatggtgaaactccatctctactaaaaatacaaaaattaaccaggcttgatggtgtgcacctgtaatctcagctactcgggaggctgaggcaagagaatcgcttgaacccaggaggcagaggttgcagtgcaccaagactgcgccattgcactccagcccgggcaacaagagcgaaaccccatctcgaaaaaaaacaaaacaaaactagacaagtgagtgcctacgtgacactcaaatgttgccagcatacagttaagggccctagtcaatgtaggcctgcttcttatagctttttgactatattatgctgtctttgacttagtcagtcaacacttattgagcacctactaagtgccaaacactctcctggactctggcaaaataaaaaatgaattaaaactct

SEQ ID NO: 2 - DNA, 2160 bp, Homo Sapian
catcgtttttccaatctgtccgcggctgccgccacccaagacagagccagaatgttcaggatgctgaacagcagttttgaggatgaccccttcttcagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatgtaaaactctttaaaacatactaattttttaaagcttatatgcttatttcgcttccccagttgtttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgttgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgttttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattc

SEQ ID NO: 3 - DNA, 2188 bp, Homo Sapian
accgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatgtaaaactctttaaaacatactaattttttaaagcttatatgcttatttcgcttccccagttgtttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgttgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgttttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattc

SEQ ID NO: 4 - DNA, 10000 bp, Homo Sapian
ggagttttccaccatgactattgccctgctgggttttgccatattcttgctccattgtgcgacctgtgagaagcctctagaagggattctctcctcctctgcttggcacttcacacactcccattacaatgccaccatctatgaaaattcttctcccaagacctatgtggagagcttcgagaaaatgggcatctacctcgcggagccacagtgggcagtgaggtaccggatcatctctggggatgtggccaatgtatttaaaactgaggagtatgtggtgggcaacttctgcttcctaagaataaggacaaagagcagcaacacagctcttctgaacagagaggtgcgagacagctacaccctcatcatccaagccacagagaagaccttggagttggaagctttgacccgtgtggtggtccacatcctggaccagaatgacctgaagcctctcttctctccaccttcgtacagagtcaccatctctgaggacatgcccctgaagagccccatctgcaaggtgactgccacagatgctgatctaggccagaatgctgagttctattatgcctttaacacaaggtcagagatgtttgccatccatcccaccagcggtgtggtcactgtggctgggaagcttaacgtcacctggcgaggaaagcatgagctccaggtgctagctgtggaccgcatgcggaaaatctctgagggcaatgggtttggcagcctggctgcacttgtggttcatgtggagcctgccctcaggaagcccccagccattgcttcggtggtggtgactccaccagacagcaatgatggtaccacctatgccactgtactggtcgatgcaaatagctcaggagctgaagtggagtcagtggaagttgttggtggtgaccctggaaagcacttcaaagccatcaagtcttatgcccggagcaatgagttcagtttggtgtctgtcaaagacatcaactggatggagtaccttcatgggttcaacctcagcctccaggccaggagtgggagcggcccttatttttattcccagatcaggggctttcacctaccaccttccaaactgtcttccctcaaattcgagaaggctgtttacagagtgcagcttagtgagttttcccctcctggcagccgcgtggtgatggtgagagtcaccccagccttccccaacctgcagtatgttctaaagccatcttcagagaatgtaggatttaaacttaatgctcgaactgggttgatcaccaccacaaagctcatggacttccacgacagagcccactatcagctacacatcagaacctcaccgggccaggcctccaccgtggtggtcattgacattgtggactgcaacaaccatgcccccctcttcaacaggtcttcctatgatggtaccttggatgagaacatccctccaggcaccagtgttttggctgtgactgccactgaccgggatcatggggaaaatggatatgtcacctattccattgctggaccaaaagctttgccattttctattgacccttacctggggatcatctccacctccaaacccatggactatgaactcatgaaaagaatttataccttccgggtaagagcatcagactggggatccccttttcgccgggagaaggaagtgtccatttttcttcagctcaggaacttgaatgacaaccagcctatgtttgaagaagtcaactgtacagggtctatccgccaagactggccagtagggaaatcgataatgactatgtcagccatagatgtggatgagcttcagaacctaaaatacgagattgtatcaggcaatgaactagagtattttgatctaaatcatttctccggagtgatatccctcaaacgcccttttatcaatcttactgctggtcaacccaccagttattccctgaagattacagcctcagatggcaaaaactatgcctcacccacaactttgaatattactgtggtgaaggaccctcattttgaagttcctgtaacatgtgataaaacaggggtattgacacaattcacaaagactatcctccactttattgggcttcagaaccaggagtccagtgatgaggaattcacttctttaagcacatatcagattaatcattacaccccacagtttgaggaccacttcccccaatccattgatgtccttgagagtgtccctatcaacacccccttggcccgcctagcagccactgaccctgatgctggttttaatggcaaactggtctatgtgattgcagatggcaatgaggagggctgctttgacatagagctggagacagggctgctcactgtagctgctcccttggactatgaagccaccaatttctacatcctcaatgtaacagtatatgacctgggcacaccccagaagtcctcctggaagctgctgacagtgaatgtgaaagactggaatgacaacgcacccagatttcctcccggtgggtaccagttaaccatctcggaggacacagaagttggaaccacaattgcagagctgacaaccaaagatgctgactcggaagacaatggcagggttcgctacaccctgctaagtcccacagagaagttctccctccaccctctcactggggaactggttgttacaggacacctggaccgcgaatcagagcctcggtacatactcaaggtggaggccagggatcagcccagcaaaggccaccagctcttctctgtcactgacctgataatcacattggaggatgtcaacgacaactctccccagtgcatcacagaacacaacaggttgaaggttccagaggacctgccccccgggactgtcttgacatttctggatgcctctgatcctgacctgggccccgcaggtgaagtgcgatatgttctgatggatggcgcccatgggaccttccgggtggacctgatgacaggggcgctcattctggagagagagctggactttgagaggcgagctgggtacaatctgagcctgtgggccagtgatggtgggaggcccctagcccgcaggactctctgccatgtggaggtgatcgtcctggatgtgaatgagaatctccaccctccccactttgcctccttcgtgcaccagggccaggtgcaggagaacagcccctcgggaactcaggtgattgtagtggctgcccaggacgatgacagtggcttggatggggagctccagtacttcctgcgtgctggcactggactcgcagccttcagcatcaaccaagatacaggaatgattcagactctggcacccctggaccgagaatttgcatcttactactggttgacggtattagcagtggacaggggttctgtgcccctctcttctgtaactgaagtctacatcgaggttacggatgccaatgacaacccaccccagatgtcccaagctgtgttctacccctccatccaggaggatgctcccgtgggcacctctgtgcttcaactggatgcctgggacccagactccagctccaaagggaagctgaccttcaacatcaccagtgggaaccacatgggattctttatgattcaccctgttacaggtctcctatctacagcccagcagctggacagagagaacaaggatgaacacatcctggaggtgactgtgctggacaatggggaaccctcactgaagtccacctccagggtggtggtaggcatcttggacgtcaatgacaatccacctatattctcccacaagctcttcaatgtccgccttccagagaggctgagccctgtgtcccctgggcctgtgtacaggctggtggcttcagacctggatgagggtcttaatggcagagtcacctacagtatcgaggacagcgatgaggaggccttcagtatcgacctggtcacaggtgtggtttcatccagcagcacttttacagctggagagtacaacatcctaacgatcaaggcaacagacagtgggcagccaccactctcagccagtgtccggctacacattgagtggatcccttggccccggccgtcctccatccctctggcctttgatgagacctactacagctttacggtcatggagacggaccctgtgaaccacatggtgggggtcatcagcgtagagggcagacccggactcttctggttcaacatctcaggtggggataaggacatggactttgacattgagaagaccacaggcagcatcgtcattgccaggcctcttgataccaggagaaggtcgaactataacttgactgttgaggtgacagatgggtcccgcaccattgccacacaggtccacatcttcatgattgccaacattaaccaccatcggccccagtttctggaaactcgttatgaagtcagagttccccaggacaccgtgccaggggtagagctcctgcgagtccaggccatagatcaagacaagggcaaaagcctcatctataccatacatggcagccaagacccaggaagtgccagcctcttccagctggacccaagcagtggtgtcctggtaacggtgggaaaattggacctcggctcggggccctcccagcacacactgacagtcatggtccgagaccaggaaatacctatcaagaggaacttcgtgtgggtgaccattcatgtggaggatggaaacctccacccaccccgcttcactcagctccattatgaggcaagtgttcctgacaccatagcccccggcacagagctgctgcaggtccgagccatggatgctgaccggggagtcaatgctgaggtccactactccctcctgaaagggaacagcgaaggtttcttcaacatcaatgccctgctaggcatcattactctagctcaaaagcttgatcaggcaaatcatgccccacatactctgacagtgaaggcagaagatcaaggctccccacaatggcatgacctggctacagtgatcattcatgtctatccctcagataggagtgcccccatcttttcaaaatctgagtactttgtagagatccctgaatcaatccctgttggttccccaatcctccttgtctctgctatgagcccctctgaagttacctatgagttaagagagggaaataaggatggagtcttctctatgaactcatattctggccttatttccacccagaagaaattggaccatgagaaaatctcgtcttaccagctgaaaatccgaggcagcaatatggcaggtgcatttactgatgtcatggtggtggttgacataattgatgaaaatgacaatgctcctatgttcttaaagtcaacttttgtgggccaaattagtgaagcagctccactgtatagcatgatcatggataaaaacaacaacccctttgtgattcatgcctctgacagtgacaaagaagctaattccttgttggtctataaaattttggagccggaggccttgaagtttttcaaaattgatcccagcatgggaaccctaaccattgtatcagagatggattatgagagcatgccctctttccaattctgtgtctatgtccatgaccaaggaagccctgtattatttgcacccagacctgcccaagtcatcattcatgtcagagatgtgaatgattcccctcccagattctcagaacagatatatgaggtagcaatagtcgggcctatccatccaggcatggagcttctcatggtgcgggccagcgatgaagactcagaagtcaattatagcatcaaaactggcaatgctgatgaagctgttaccatccatcctgtcactggtagcatatctgtgctgaatcctgctttcctgggactctctcggaagctcaccatcagggcttctgatggcttgtatcaagacactgcgctggtaaaaatttctttgacccaagtgcttgacaaaagcttgcagtttgatcaggatgtctactgggcagctgtgaaggagaacttgcaggacagaaaggcactggtgattcttggtgcccagggcaatcatttgaatgacaccctttcctactttctcttgaatggcacagatatgtttcatatggtccagtcagcaggtgtgttgcagacaagaggtgtggcgtttgaccgggagcagcaggacactcatgagttggcagtggaagtgagggacaatcggacacctcagcgggtggctcagggtttggtcagagtctctattgaggatgtcaatgacaatccccccaaatttaagcatctgccctattacacaatcatccaagatggcacagagccaggggatgtcctctttcaggtatctgccactgatgaggacttggggacaaatggggctgttacatatgaatttgcagaagattacacatatttccgaattgacccctatcttggggacatatcactcaagaaaccctttgattatcaagctttaaataaatatcacctcaaagtcattgctcgggatggaggaacgccatccctccagagtgaggaagaggtacttgtcactgtgagaaataaatccaacccactgtttcagagtccttattacaaagtcagagtacctgaaaatatcaccctctataccccaattctccacacccaggcccggagtccagagggactccggctcatctacaacattgtggaggaagaacccttgatgctgttcaccactgacttcaagactggtgtcctaacagtaacagggcctttggactatgagtccaagaccaaacatgtgttcacagtcagagccacggatacagctctggggtcattttctgaagccacagtggaagtcctagtggaggatgtcaatgataaccctcccactttttcccaattggtctataccacttccatctcagaaggcttgcctgctcagacccctgtgatccaactgttggcttctgaccaggactcagggcggaaccgtgacgtctcttatcagattgtggaggatggctcagatgtttccaagttcttccagatcaatgggagcacaggggagatgtccacagttcaagaactggattatgaagcccaacaacactttcatgtgaaagtcagggccatggataaaggagatcccccactcactggtgaaacccttgtggttgtcaatgtgtctgatatcaatgacaaccccccagagttcagacaacctcaatatgaagccaatgtcagtgaactggcaacctgtggacacctggttcttaaagtccaggctattgaccctgacagcagagacacctcccgcctggagtacctgattctttctggcaatcaggacaggcacttctccattaacagctcatcgggaataatttctatgttcaacctttgcaaaaagcacctggactcttcttacaatttgagggtaggtgcttctgatggagtcttccgagcaactgtgcctgtgtacatcaacactacaaatgccaacaagtacagcccagagttccagcagcacctttatgaggcagaattagcagagaatgcaatggttggaaccaaggtgattgatttgctagccatagacaaagatagtggtccctatggcactatagattatactatcatcaataaactagcaagtgagaagttctccataaaccccaatggccagattgccactctgcagaaactggatcgggaaaattcaacagagagagtcattgctattaaggtcatggctcgggatggaggaggaagagtagccttctgcacggtgaagatcatcctcacagatgaaaatgacaaccccccacagttcaaagcatctgagtacacagtatccattcaatccaatgtcagtaaagactctccggttatccaggtgttggcctatgatgcagatgaaggtcagaacgcagatgtcacctactcagtgaacccagaggacctagttaaagatgtcattgaaattaacccagtcactggtgtggtcaaggtgaaagacagcctggtgggattggaaaatcagacccttgacttcttcatcaaagcccaagatggaggccctcctcactggaactctctggtgccagtacgacttcaggtggttcctaaaaaagtatccttaccgaaattttctgaacctttgtatactttctctgcacctgaagaccttccagaggggtctgaaattgggattgttaaagcagtggcagctcaagatccagtcatctacagtctagtgcggggcactacacctgagagcaacaaggatggtgtcttctccctagacccagacacaggggtcataaaggtgaggaagcccatggaccacgaatccaccaaattgtaccagattgatgtgatggcacattgccttcagaacactgatgtggtgtccttggtctctgtcaacatccaagtgggagacgtcaatgacaataggcctgtatttgaggctgatccatataaggctgtcctcactgagaatatgccagtggggacctcagtcattcaagtgactgccattgacaaggacactgggagagatggccaggtgagctacaggctgtctgcagaccctggtagcaatgtccatgagctctttgccattgacagtgagagtggttggatcaccacactccaggaacttgactgtgagacctgccagacttatcattttcatgtggtggcctatgaccacggacagaccatccagctatcctctcaggccctggttcaggtctccattacagatgagaatgacaatgctccccgatttgcttctgaagagtacagaggatctgtggttgagaacagtgagcctggcgaactggtggcgactctaaagaccctggatgctgacatttctgagcagaacaggcaggtcacctgctacatcacagagggagaccccctgggccagtttggcatcagccaagttggagatgagtggaggatttcctcaaggaagaccctggaccgcgagcatacagccaagtacttgctcagagtcacagcatctgatggcaagttccaggcttcggtcactgtggagatctttgtcctggacgtcaatgataacagcccacagtgttcacagcttctctatactggcaaggttcatgaagatgtatttccaggacacttcattttgaaggtttctgccacagacttggacactgataccaatgctcagatcacatattctctgcatggccctggggcgcatgaattcaagctggatcctcatacaggggagctgaccacactcactgccctagaccgagaaaggaaggatgtgttcaaccttgttgccaaggcgacggatggaggtggccgatcgtgccaggcagacatcaccctccatgtggaggatgtgaatgacaatgccccgcggttcttccccagccactgtgctgtggctgtcttcgacaacaccacagtgaagacccctgtggctgtagtatttgcccgggatcccgaccaaggcgccaatgcccaggtggtttactctctgccggattcagccgaaggccacttttccatcgacgccaccacgggggtgatccgcctggaaaagccgctgcaggtcaggccccaggcaccactggagctcacggtccgtgcctctgacctgggcaccccaataccgctgtccacgctgggcaccgtcacagtctcggtggtgggcctagaagactacctgcccgtgttcctgaacaccgagcacagcgtgcaggtgcccgaggacgccccacctggcacggaggtgctgcagctggccaccctcactcgcccgggcgcagagaagaccggctaccgcgtggtcagcgggaacgagcaaggcaggttccgcctggatgctcgcacagggatcctgtatgtcaacgcaagcctggactttgagacaagccccaagtacttcctgtccattgagtgcagccggaagagctcctcttccctcagtgacgtgaccacagtcatggtcaacatcactgatgtcaatgaacaccggccccaattcccccaagatccatatagcacaagg

SEQ ID NO: 5 - DNA, 707 bp, Homo Sapian
atggagtgggaaaataggaaaagaggcactgctggaagacagaagataaactgtattttgtggttttgtgtaagcctgccattgccttcatctagacctgccaagtgtgacagatttggacacactggaaaagttaacgttttcagtgggaagttctgggtttcagttccttctgtcagtttaggtatcatcagcatcatcattagaatcactaaggagtcagagaaagctcttgaccttctggacttgatgtacaatttgaatgagaattctcttcctggaaacttcatctaccttactaccttccgtgcactcttatatattaggaagctcacaaagttgcagatacccagctttagggataacaacctgatcttgcagcctagggaaactggggagtttacccagcttaaggaactcaacattcagggcaactgcctgacccttctgctcccagaactaggaaacttatatttaactggtcagaagaaggtatgcaaagtggagaacagcccctgggttaccccaattgctggccagttccagcttgatgtgtcctgtgtgtctgaatgtgtctgttctgagacatatgagtacctctatggcagcacatgcaggcaaatccagaaccaccaaaacataataatcacaaatcagaaaagatgagctggaaacacctgacagacagtaacaaataagaggtgggc

SEQ ID NO: 6 - DNA, 1831 bp, Homo Sapian
ccgttgcggcccccacctgcagtatggagtcgtctcgggggcggcccgggcccgagacggaccttctggctgtagcggaacatcaggccctagtctttggcggcgggccgggccgaacgtcctctgagccgcccgcaggcctccgggtgtccggggaggaagagaccgagaacgttgggggcgcgaaccgccaccccaggacgtccccgaagacgtcaagctgcggcgtcgtccaccggccggaacgggaggctctggagaacgagcccggccctcaagggacgctgtctggggccgggagccgcaggggggcgccgggtgcagagcacgaaccttccctgtcctcccggcacaagaacccggcgccgcccgagggcaagccctcctccgggagggactgccgtcgagggggaccaggcggcgggatggatgttgagcagcaggaggaggaagacaacgacgaggaggcggccgcgggcagcagagccggccgctcgttctccagccgtcttcaggacagccgcagcctggacgggctgagcgaggcgtgcggtggcgccgggtcctcagggagtgccgagtccggcgcgggcggcggacgccgcgccaccatctccagtcccctggagctcgaaggcacagtgagccgccacggcgaccttacccactttgtcgccaacaacctgcaactcaagatccgtctgagcggcgcgcctccacccccgccttctgcccctgcgcggccctgcccagcgcctgcacccacacccacaccggccattccccccatcgaccccgaggtgctgcgggatctggagcggttgagtcgggagctgggaggccgggtggaccgtctgcttcgcggtctgggtggcgcggtgcaggagctgacggcgctgagcgtgggttgcatccagacctaccgcgatgctgtggactccttaggtgaagccgtggacatgagcatcaagggcatgtacaccctgctggcgcgctgcgaggagctggagcgggctctgcagccggttcaggggctggcgcgccaagtccgggatatccgacgtactctggaggtgttggaggccctgtgcaagtgaccaggaggacaggagaggccggtcctggccagggcagggcccagcaggaccctaaggactcttcagggagtcctggtgggaagtgcccactgaggggaggcctgtgtgttggaggctcttccagatgcgttcagctggcccgtgcccactcgctgggccttaggctggtgtatgtggggaagttctaacggctctcctggtgggaagggatgttgctctgcttgtattcagttggccatctgtagctaccctgttcttcccaactctcctccctagctagagcaccagccctgggaacacggggctttaggtctgcttgaaggtgaggacgtgactcccacatgtaatcaggagaaagggacagaggaagccccagcccccactgtggctatcctgactccagtggccacatctcaggtgccaggggctgtgggagcttgtgccgtccttggccaaacaccccgcaggcaaagatgcacccctgctgatggagagccttctgcttctgccctctggccctctaccataccacttccccagccagaaccggcgtgcagctaggaggaatgggttgcacggcggagggggtgaggtgggaggcgtctcactgctctcagggttcaggtagaatgttgctggttttgaagctcacctgttgtggagtgttctaatcagttttggctttctgagtttttgtggaattaaagtgctgctgctgcgaaggctgaggctga

SEQ ID NO: 7 - DNA, 1356 bp, Homo Sapian
tggaagggcctcctcagcaggttgtcagccagctggaagagcctggggccacctgtctggtcagagtctctctgctgtgggcctcttggagccagggctggttttgtggtctgactgaagtgacaatgaaattaataggatcctgatgctgtgactgaggccatttccctgtgtctccaaacaggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctc

SEQ ID NO: 8 - DNA, 3102 bp, Homo Sapian
atggtggacatgggggccctggacaacctgatcgccaacaccgcctacctgcaggcccggaagccctcggactgcgacagcaaagagctgcagcggcggcggcgtagcctggccctgcccgggctgcagggctgcgcggagctccgccagaagctgtccctgaacttccacagcctgtgtgagcagcagcccatcggtcgccgcctcttccgtgacttcctagccacagtgcccacgttccgcaaggcggcaaccttcctagaggacgtgcagaactgggagctggccgaggagggacccaccaaagacagcgcgctgcaggggctggtggccacttgtgcgagtgcccctgccccggggaacccgcaacccttcctcagccaggccgtggccaccaagtgccaagcagccaccactgaggaagagcgagtggctgcagtgacgctggccaaggctgaggccatggctttcttgcaagagcagccctttaaggatttcgtgaccagcgccttctacgacaagtttctgcagtggaaactcttcgagatgcaaccagtgtcagacaagtacttcactgagttcagagtgctggggaaaggtggttttggggaggtatgtgccgtccaggtgaaaaacactgggaagatgtatgcctgtaagaaactggacaagaagcggctgaagaagaaaggtggcgagaagatggctctcttggaaaaggaaatcttggagaaggtcagcagccctttcattgtctctctggcctatgcctttgagagcaagacccatctctgccttgtcatgagcctgatgaatgggggagacctcaagttccacatctacaacgtgggcacgcgtggcctggacatgagccgggtgatcttttactcggcccagatagcctgtgggatgctgcacctccatgaactcggcatcgtctatcgggacatgaagcctgagaatgtgcttctggatgacctcggcaactgcaggttatctgacctggggctggccgtggagatgaagggtggcaagcccatcacccagagggctggaaccaatggttacatggctcctgagatcctaatggaaaaggtaagttattcctatcctgtggactggtttgccatgggatgcagcatttatgaaatggttgctggacgaacaccattcaaagattacaaggaaaaggtcagtaaagaggatctgaagcaaagaactctgcaagacgaggtcaaattccagcatgataacttcacagaggaagcaaaagatatttgcaggctcttcttggctaagaaaccagagcaacgcttaggaagcagagaaaagtctgatgatcccaggaaacatcatttctttaaaacgatcaactttcctcgcctggaagctggcctaattgaacccccatttgtgccagacccttcagtggtttatgccaaagacatcgctgaaattgatgatttctctgaggttcggggggtggaatttgatgacaaagataagcagttcttcaaaaactttgcgacaggtgctgttcctatagcatggcaggaagaaattatagaaacgggactgtttgaggaactgaatgaccccaacagacctacgggttgtgaggagggtaattcatccaagtctggcgtgtgtttgttattgtaaattgctctctttaccagacaggcagcaggagtctcggctgacataatcctcgaatgttccacacgtggaaatctgtggaatgagggctaatcagttaggagggacatcacaaccacaaaacaattcaaaagacaggcaagctcactactagaacacattttattttctttttctttcttcataaagatgagtaaagtctcagttttcactgagggcagggaaaaggaacactcaggtttattttgataaactgaaagcatcagccttttaccatcatgtccctgtgtattacgcaaagtcctaggaacagagaatggaactttgtggtgtgcccagaaaatgagcatttgcaattcttagtaaataatcattttagtttttctttgtttatatctttttttcccttcatctttcttcgcttctatacttataaaaaggattttgaagctggaaacaaatgtttctgacattctccccctaaaaaggagtggattacaatattttggcaatgttttaaatcacagaataattttcaatttcagtgacagtttcttttgcaattttgtggaaataatttactatcataatgttgaagcattttaaacataaacatccatgacatctgtgaattaaagcattctgtaaatttagttgagtcctttaagtaatatggtacaaattgcttcaacttgcactaccatatgccatcggttcccaaactctgctgaactttggaatcatctagggatcttttaaaaaactaatgcctgattcccatccatagacattctgatccccactcccaggtatgagaacagcttgaccatttagaatttcagaagctccccaggtgattctaatgtgcagcagagtttggcaggcactgctgtgcacatttgaatgttattacattcaatcttattttggttgctcaaaacttcaatcatacattttgatggcaacttttcaaatgtccccaaagcatgtcattttagtaattgcagtataaatgaaacaagacagtctattcatcttatggcttctcttgtccttgcacactttagtttctcacacgtatcttgggagctcggtctcttggctatttcaagtcctgaaggagacctatgggcttagaaattgagttgaacaggccaggtgcggtggctcatgcctgcaattccagcactttgggaggccaaggcagatggatcatgaggtcaggggctcaagactagcctggccaacatgttgtaaaccccgtctctactaaaaatacaaaaattagcccggtgtggtggtgcacatctataatcccagttacccgggagcctgaggcaggagaattgcttgaacccaggaggcggaggttgtagtgagccaagatcgcaacattgcactccaggctgggcagcaagagcaagactctatctcaaaaaaaaa

SEQ ID NO: 9 - DNA, 1111 bp, Homo Sapian
cggccgcgcggccccgcccgtcggcctcgctcccgccacagagcccgcagcacgccgccgccgcagcctaggtcacagatctgtgaaaatctttaaaggcatgtgttttgccatatatgcaagtgaatcaacttgccagataaaagtttgctgcctaaatatgattactaggaaagccaagtctctcttcctggatttcttctcctataaaccgcctattgatacctacccacttctctatggagcacagatgaaggatattggtcatctccagcatctagcacaacgtctgcaatggaacaggcgagctgtgaatatttgtggaatgcatgggtggactaaagacctatcacctcactctagaatgcccagcatgttggagcatgttaagcactatatgagctgctgaggatacaggaataaacaacaacacaggtgtgtcctctgcccaaaccaggcataaatgagcttccaaatgaacacaaacaaatctggaaggcttttgaggaagaaggaccattaaaaaagctgctgacgactgcctggaatctggtttggagcatctccaaagccaacgtactttcccccaagaaaatacaggaagatctctctgcccaggcttggaaatacataaggatcaggtttgccatcctctactttagggtgactttaacataattcaatgcccactgactgcttttctcctacaggtaaagtaacaaacaaaggagtcaactctcaggagctctctctttcatctgctttatgttgccattttccctcattgccctctcacattcactcagtaattcaccaaatatttatagagacttcatggtgtgcaaggcagtgaactccacactgtaggaagagtaaagccatggagatcgcaggcctggctcttcatacctttggctttctgttgaattgaactttctgttaagtttaaaatacacaatagaactttgacgatgttgtggcctggtcagggatgggacagataaccagcccttaaaaataaagctcctccggccccgcccaataccttctgaaagaaggagggttattatagagcataaataaaacagtagtgattaataatgataataaa

SEQ ID NO: 10 - DNA, 592 bp, Homo Sapian
gtgtgggatccgggctggtagcatgagccaggtgcacctgccaggccgagtgggtggaacaagcctagtgggcctgagcaaaactcgagcaaaggtgtcaccagccacaaaggtttccagctgccccctgcgtgagtgtggcacaggaggtacgtgggactctcccccttcaatatgcggaactgggggcagtgaaggtgctgttatgccaagcctcagtggaggcctccatgggcgaaaccctcagtggtgggagaggcagaggctgtggcaaggggtcttcattcctgcaggttttcctggagactctgggggaaacagagcaggagtagaggaagaatggaagctgccacgcacattcatgaagcaaaaattccctgtacctcatcatggccacgggcatgagggaatgatgctggatcatgaccttaaaggaaccatgcagctctatgggcatgaagaagccatgcagtatgatggccatgagggaaccatgaggctccatgggcatgaggaaccatgcagctccatggccataagggaatcatgcagctacagggccatgaggagccatgcagcttcatgtgcatga

SEQ ID NO: 11 - DNA, 1145 bp, Homo Sapian
gcccagggctctcggatgcagggagcctgggcccaaacagcagcttccggagtcggaaggagctgaggaagaagactgactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcaccttaaatttgctgttgaagaaattatacaaaaacaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtgcaaagaaatgatgactttattgaattagactacaccattctacttcataatatagcatctcagttccatggaatccatgacagcaccaactccatctttacctttcacctaaacacaagcacagcaattcagactttctctgtccctgcattccaagaaggaaagaaatcttaactgaaatggaaacagttgccaggtgcagtggctcatgcctataatcccagcactgtgggagactgaggcaggatgataatttgagcccaagagtttgagaccagcctgagcaacaaagtgagacctcttctataaaaaataaaaataaaaccagaacacagatacttaacttaagcaactttcagataagcctaactgtcaaaagtccgctgttaccattgttttaatctttcaggtttataagctttattaaataatag

SEQ ID NO: 12 - DNA, 1111 bp, Homo Sapian
gcccagggctctcggatgcagggagcctgggcccaaacagcagcttccggagtcggaaggagctgaggaagaagactgactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcaccttaaatttgctgttgaagaaattatacaaaaacaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtgcaaagaaatgatgactttattgaattagactacaccattctacttcataatatagcatctcaggagattattccctggcaaatgcaagttctctggcatccacaatacggcactaaagtaaaacataatagccgtctgccaaaggaagtacaactggaataaacaaaaaccctaacactggaagtgtaaacatgtctattgatgtgtatgccaatttcactggcatctagcttatgaggccaaataatcccaaagtgtcactttatataaatgtcttgattacagtatagaactttatagagtccataatacaaagtatcactacataaaaatgtctttaaaacagtaatagtggtatgtatatccaaaataaaaagcttcaatttcagcctcataatgt

SEQ ID NO: 13 - DNA, 2542 bp, Homo Sapian
agtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgtagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgtcgggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaattatttcctttgtaccttgtcctgttccaggagctgaggtcaaagaagaaaaagtttgtggtctcctggagagtttgtggggttaattttaagtggtatcattacactcaggcaatctagtcaggcggtgcaaatatctacattaggtgaaatggacatggagtaactgtgtccaggggacgcgataatttattgttcaaggagtag

SEQ ID NO: 14 - DNA, 2488 bp, Homo Sapian
gttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgtagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgtcgggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaattatttcctttgtaccttgtcctgttccaggagctgaggtcaaagaagaaaaagtttgtggtctcctggagagtttgtggggttaattttaagtggtatcattacactcaggcaatctagtcaggcggtgcaaatatctacattaggtgaaatggacatggagtaactgtgtccaggggacgcgataatttattgttcaaggagtag

SEQ ID NO: 15 - DNA, 4239 bp, Homo Sapian
ggccactacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacaatgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagagggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtctgctgtggcagattccccagataaccaaggaaaaggggccacccatacctggaaataggccatagggcccctactactgccaacaagccatggcctaccttgacaattgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgaacttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatgtgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaactggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttggaagctc

SEQ ID NO: 16 - DNA, 10000 bp, Homo Sapian
gtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagtgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttca

SEQ ID NO: 17 - DNA, 10000 bp, Homo Sapian
gtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttat

SEQ ID NO: 18 - DNA, 10000 bp, Homo Sapian
tgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaa

SEQ ID NO: 19 - DNA, 1859 bp, Homo Sapian
gtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctggtgagtagacttgctcactggagaaacttcaagcactaatgctttcggaatgtgaggcttttccttggacagcatgactttgttttgtagaaaagtacggctggctgggagtttgtgatataatttagttcagtggtattctaagtgttcttagtgttctttcagacttttgggccatctcccaaagggtgaatgggaagaataagctgggtgtggctgagtttaagccaaaagttttttgtgcttgtttcaatcagagaagacctgctttttcatgtttttactattataatactaagcaagagctcatttgaaaacagagttcttcatatttaaaaaaaaaaagtcttgaaaccattgatgggaagatggatatctatttatgtttaaaaacccatcataaagatgacattgtgggctgtcacagttggaaggccctggaattagatgagaccacactatttagcttacttagtaataacattgcaaagaaaaattccgacgaagttttttcagcctaggaatcaatagttcagagaagcactctatgagaatacccattcattcttaaccaaaaaatactggtgagcctgagcagtttggtcatcagagtgttttatatagttccagaacaaatatgtctctaggtgttctgagagctctggtgaaattcctctcgctaccccaaacatcatcatttaatatccaggattctggttttctactcaccagatagattctcttaaaaccagggaaagattcctggaggaaggatgtatctggaaagagatgttccttattataataaaatgaaattgtaatactc

SEQ ID NO: 20 - DNA, 1402 bp, Homo Sapian
gtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgatggatgtgacatgtgatgacattgcacatgggcagttaactgtgccaagaagtgcagcagtagcagcaaccggagatgcaaagcccaacatgatggggagagaaactcttctttcaatatgtgcttctgtaccaaaagtggaatttcacgagagacatattttgaaacatttctccttttgtgtgtgcgtgagtgtttccctgtttccagccaagggtattgtgagtttctcctgggcctccttcagaatctgggtgctctggaaagcagtgttttggcaacatggggaaagtatggcagtgtgggagggtcagctgggtctgggtttgaatattgcatttgaatattttaccagcattgatgtcgga

SEQ ID NO: 21 - DNA, 2904 bp, Homo Sapian
ctcttacaacattggctgccggcgtgactttgaccgcttcccggtgcgttaccggcagctgaacccacccggcgccacgggactttgacgcgtgctctgcgcttgccatgagactcctgggagctgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaaaactacattaacagaacgagtcctttactacactggcagaattgcaaagatgcatgaggtgaaaggtaaagatggagttggtgctgtcatggattccatggaactagagagacaaagaggaatcactattcagtcagcagccacttacaccatgtggaaagatgtcaatattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattgtagatcttattgaggaacgagccatctattttgatggagactttggtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaaggcaacaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggagtttttgtctaggtcctttttccgtctcactagacagaaggaccacagaaggcccatccagaggaccacgttatatttgattgtcatgtctccttatgatctcctaggctgtaatagtttcttagactttccttgtttctcacgagattgatatttttgagaagtattggtcagctcttttgtagagtgtccctcaatttgggtttattatttgatgcttttcacatgattagattggagtcatgtgtttttaggaggactgccatcgaggtgaagtgttattcttgtcacatcatatccaaggtacagacttgcagcatgatttatcattgtttttgtttttttttgtttttatttttatttttttgagatgagatttcgctcttgttgcccaggctggagtgcaatggcacaatctcggctcgctgcagcctccacctcccaggttcaagcgagtctcctgcctcagcctcccaagtagctgggattacaggcatgcgccaccacgcccagctaattttgtatttttagtagagacatagtttctccctgttggtcaggccggtctcgaactcctgacctcaggtgatccgagtgtcttggcctcccaaagtgctgggattacaggcatgagccaccgcacccggctgatttatcattgttaatgctaacctcaatcaccacacctggctgagatagtgtttgacaggtttctctgctgtaaagttactgtactctttttattccccttttcatagtgtactttttagaaggaagtcacttggctcagccaacacttgaggggggaattatgttccacccccttgaagggggcactatctacataagttatttggaattcttctgaaagggagatttgtctttcttccctgcttatttatctatttggacaatcacttatttaatatcagcgtggactcacgtatatgtattttgaactttgagttataactatgactttgagtatgtcatttgttgttcagattggctgggtttggcgattgggaactctcagttggctcctgtgttcctttaacatcttccaatgttttgcctttttgaatacttccttacttgctggcactacaagacgcctcaggcttatcttgtatattccatgccctaaccctagaatcagccgttctccaaggagcactggttcctttttaagtaaaatggtattagaaaccaagatttggggactggatgggctttttgttgaaatgctgttgcttctgtacataatattttaagtggggaaaaatggtagataagttggaagtgttaagagtggttatttctgggatgggattatattttgggggctttttcttactttaaaaatattttacagtatatttattacctccaaaatgaggggaaaatttttttaattaaaaagtggaaataacattacagtaaaagtatttacacataaagcttttaaaaatacatatataagaatattttcttaggattcccagaatagtgattattgagttaaaggcatagaatgttttcatagttaatggtttatattgccagattgcgttcatactctccaaattaatgtattggattatttcaatgaatatcatcattgagtattgtttaaaaatcattactgatttaacaaatgaagaattctattgtaatcttttatcttgatgaaataaattttgatttttaaaagc

SEQ ID NO: 22 - DNA, 3263 bp, Homo Sapian
acccggtctcacttcgctcctgggcagctgcgcggagaactggggcactttgttttagtaaaatcggaggtgaagatggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataaaacagctagactttgtgaatgatacagagaagtccacaacacgtgtaaactcctgggttgctgataaaactaaagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctctatgtgctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattgtgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatctt

SEQ ID NO: 23 - DNA, 3026 bp, Homo Sapian
gaagcatctacaaaggaggaatagtcaaagcagcagcggcggcggcggcggcggcagcagcagcagcagcaggagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctctatgtgctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattgtgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatctt

SEQ ID NO: 24 - DNA, 6382 bp, Homo Sapian
actggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggccaaggccaacatgcagctcctatatgagcgtcttctcagaagaaaacagctacgaacacagaaagacaaccatctagaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaacccttgtaatcctttgcttattctctgaatactagaggtatatatattttatttataacatagacca

SEQ ID NO: 25 - DNA, 5692 bp, Homo Sapian
actggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcattctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaacccttgtaatcctttgcttattctctgaatactagaggtatatatattttatttataacatagacca

SEQ ID NO: 26 - DNA, 5919 bp, Homo Sapian
actggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcaggtgctgttatcagaatagtcttctgggtataaattaaaaatgactgaagttcaagcaatggtagaattctctgtggagctaaacaagttctacaatgtggatttgtttcagagaggggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaacccttgtaatcctttgcttattctctgaatactagaggtatatatattttatttataacatagacca

SEQ ID NO: 27 - DNA, 6304 bp, Homo Sapian
actggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaacccttgtaatcctttgcttattctctgaatactagaggtatatatattttatttataacatagacca

SEQ ID NO: 28 - DNA, 6170 bp, Homo Sapian
actggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagggggaacggtgtatttttaacaacgggaatcagtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaacccttgtaatcctttgcttattctctgaatactagaggtatatatattttatttataacatagacca

SEQ ID NO: 29 - DNA, 900 bp, Homo Sapian
gctgtggcctctcctagcgaggggacatgactcctgcagaagtcctggctcaccgtccagtctgcatgcagggccaggccaggtgtgcccatgtccagttccttcctgcctgagcctttacctgccaagagcctgcaacatggggttcccttgtcccttgactcttctctctcttccctcctagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtct

SEQ ID NO: 30 - DNA, 1364 bp, Homo Sapian
ggcagtgggactgggtttgagctgggcttatcctccaactgtgagggaggctacagcacactccaccccactctcagggctgggaattgttgtggctcagctatttgggggaatctgttttccagtttctcagaaccagcgcaagcacacacatcccaggctcacacccctggtggctggacttgctcccggatagcctcagtcagggagaggcagagctgcctggagcctgctgggctggtggaagccttggtggattctggcaggccaattatagacgaatggcctggggaacccgtgcagcccttggctgagtggttctaagccccagcacgtctgcctctggcttcacccagcctccttttctaactgcccttctctcctccccatcagtgaggaccagacaccactgattgcaggaatgtgttccctccccatggcaagatactacataattaaatatgcagaccagaaggctctatacacaagagatggccagctgctggtgggagatcctgttgcagacaactgctgtgcagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctct

SEQ ID NO: 31 - DNA, 1830 bp, Homo Sapian
gagacctgtcaatcaatcaatcaatcaatcaatcaagaggaggctggcgggagcatgctcgtgaccaccgggggcgacatagaccctaaccctaagtccaaccccaaggcagaccccaccgtcccgccaggcgcactcctaagagcgcggcttccggagcaaagccgctgacccccgcccccagggtcttggcgccgattggccaacgagagcgcagggcggagccaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtgagggcccgagagtgtgtaatgtcctggaagggcggtagcggggacgcagagatccaggtaagcatcctgactctgatccccttaggtagcaaaggacgtgacacttcatcaggccttgctgaggctgccccagtaccagactgatctcttgcttaccttcaatcagcccccgtaaggaggaaggaacgggcgggtatctcatgactgggttcccaggagaatcgggctgggagggacagaacagggagactcactggtgggatcctccaaggaagcaggagtgggccagaggtttggggtaactgatacccaggtcctctggggaacaggaattggcaatttccaaacctcaggcctggatgatgttctgtctccatctgttcccccaccccaagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaatataatctctgtgcctttgaatctaacaggacacctgggtcccagacgcctgggaattgggtctctcaattccctttggttttggagggaggagtttaaaactgtgcatgggagcaggagggactcaagggtggcagtggtgagtgggaggaaatacactttgggatgactcgttcagccctgagagaggggtgtgagttacccagggaatgggtagggaaggtttaaagcaacacccaaggaaagaagggaaactcatctcttgtagtgattcaaccctgagaacagatggggagtggggttggctgtcccccatggatggatgaaaggtcacctaatcagtagtcaccaggacatagtggtggaggcacaagtggccaaggagtgctcatttggtggagactgggaaagcggctgttatttagtgtctgtgtagtagagggag

SEQ ID NO: 32 - DNA, 2198 bp, Homo Sapian
gttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcattt

SEQ ID NO: 33 - DNA, 3612 bp, Homo Sapian
caagcgagcacctgcccctcccgggggcggagctccggcgcatcatggcggctggccgggcccaggtcccttcctccgaacaagcctggcttgaggatgctcaggtcttcatccaaaagaccctgtgtccagctgtcaaggagcctaatgtccagttgactccattggtaattgattgtgtgaagactgtctggttgtcccagggaaggaaccaaggttctacactgcccctcagctatagagaaacaagctcagaggtgtgcagcgaaacctggctgggagtctagttcgattgagtgctctggtgaaaagtaaacagaaagcttacttcatcctgtctcttggtagatcacacccagctgtcacccacgtgtccatcatcgtgcaggtccctgcccagctggtgtggcacagagcccttcggcctggtacagcctatgtgctgacagaactgcgagtgtccaagatccgtggtcagcgccagcatgtttggatgaccagtcagtcctcccgtctgttgctgctgaaaccagaatgtgtgcaggagctggaactggagctggaaggacccctcttagaggctgaccccaagccactccccatgcccagcaactcggaggacaagaaggatccagaaagtcttgtccggtattctagactcctatcctattcgggagcagtcactggcgtgttgaatgagcccgctggcctctatgagctggatgggcagctggggctctgccttgcctaccagcagttccgtggccttaggcgggtgatgcgacctggagtgtgtctgcagctccaggatgttcacctgctccagtcagtgggaggggggacaagaaggccagtgctcgccccctgcctccgtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcattt

SEQ ID NO: 34 - DNA, 3613 bp, Homo Sapian
caagcgagcacctgcccctcccgggggcggagctccggcgcatcatggcggctggccgggcccaggtcccttcctccgaacaagcctggcttgaggatgctcaggtcttcatccaaaagaccctgtgtccagctgtcaaggagcctaatgtccagttgactccattggtaattgattgtgtgaagactgtctggttgtcccagggaaggaaccaaggttctacactgcccctcagctatagagaaacaagctcagaggtgtgcagcgaaacctggctgggagtctagttcgattgagtgctctggtgaaaagtaaacagaaagcttacttcatcctgtctcttggtagatcacacccagctgtcacccacgtgtccatcatcgtgcaggtccctgcccagctggtgtggcacagagcccttcggcctggtacagcctatgtgctgacagaactgcgagtgtccaagatccgtggtcagcgccagcatgtttggatgaccagtcagtcctcccgtctgttgctgctgaaaccagaatgtgtgcaggagctggaactggagctggaaggacccctcttagaggctgaccccaagccactccccatgcccagcaactcggaggacaagaaggatccagaaagtcttgtccggtattctagactcctatcctattcgggagcagtcactggcgtgttgaatgagcccgctggcctctatgagctggatgggcagctggggctctgccttgcctaccagcagttccgtggccttaggcgggtgatgcgacctggagtgtgtctgcagctccaggatgttcacctgctccagtcagtgggaggggggacaagaaggccagtgctcgccccctgcctccgtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgaggttcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatt

SEQ ID NO: 35 - DNA, 2740 bp, Homo Sapian
gtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcattt

SEQ ID NO: 36 - DNA, 4663 bp, Homo Sapian
cctgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 37 - DNA, 3123 bp, Homo Sapian
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacagggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctcc

SEQ ID NO: 38 - DNA, 2565 bp, Homo Sapian
gtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccacctacgttttccgggtacgtgctcccttcggcgctcagcgttggggtcccaatcctctccccaggggcgctcacgcaccggctctccgtccgtcccttggggtccccctatccctgcgctgggctgggctggcctgggctgggctgggggcccctgcccttatccaggccccctgggcgggagccctctcccagtggcagtgcccctggacagctggagggcgcttcctggaacacgccgctggccccacaggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccatgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctcc

SEQ ID NO: 39 - DNA, 2861 bp, Homo Sapian
gtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccacctacgttttccgggtacgtgctcccttcggcgctcagcgttggggtcccaatcctctccccaggggcgctcacgcaccggctctccgtccgtcccttggggtccccctatccctgcgctgggctgggctggcctgggctgggctgggggcccctgcccttatccaggccccctgggcgggagccctctcccagtggcagtgcccctggacagctggagggcgcttcctggaacacgccgctggccccacaggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccagtgagctgggatgggtttctgcggggtcccggggctgacttcaagaccactcaccgcagcagagccgtggtagactcctctgggattctaagataggaaggagctggggaggcctggggaaaacgtttaccttaatgagcatctggaggggtgtcctgggcaggtgggggagggagagttgatgggcaggtggagggtgtgccgttattcttcccacccccagtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtgagttgagtgctgcccgggaagggaggtccttcacaaccatgggtgggcatgaactcctgcctctccccaggtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctcc

SEQ ID NO: 40 - DNA, 2940 bp, Homo Sapian
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctcc

SEQ ID NO: 41 - DNA, 3421 bp, Homo Sapian
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggccccctgggcgggagccctctcccagtggcagtgcccctggacagctggagggcgcttcctggaacacgccgctggccccacaggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacagggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccagtgagctgggatgggtttctgcggggtcccggggctgacttcaagaccactcaccgcagcagagccgtggtagactcctctgggattctaagataggaaggagctggggaggcctggggaaaacgtttaccttaatgagcatctggaggggtgtcctgggcaggtgggggagggagagttgatgggcaggtggagggtgtgccgttattcttcccacccccagtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctcc

SEQ ID NO: 42 - DNA, 3209 bp, Homo Sapian
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggccccctgggcgggagccctctcccagtggcagtgcccctggacagctggagggcgcttcctggaacacgccgctggccccacaggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacaggggtaggtgcaccggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccatgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctcc

SEQ ID NO: 43 - DNA, 10000 bp, Homo Sapian
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgacggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaagcctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcagtgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccag

SEQ ID NO: 44 - DNA, 10000 bp, Homo Sapian
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaagcctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcagtgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcgaatctgtgcagagagtaacgcggagtgtcaagagatgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcacct

SEQ ID NO: 45 - DNA, 10000 bp, Homo Sapian
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagagtgacggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaagcctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcagtgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcgaatctgtgcagagagtaacgcggagtgtcaagagatgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcag

SEQ ID NO: 46 - DNA, 4374 bp, Homo Sapian
tctagagccgccgagcagacgcccggtgaattctagaggcggcggagggtggcgaggagctctcgctttctctcgctccctccctctccgactccgtctctctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcgcctccagctcggtgcaccgccaccccttcctcaatctgaacaccatgcgcccgcggctgcgctacagcccctactccatcccggtgccggtcccggacggcagcagtctgctcaccaccccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctttg

SEQ ID NO: 47 - DNA, 4372 bp, Homo Sapian
tctagagccgccgagcagacgcccggtgaattctagaggcggcggagggtggcgaggagctctcgctttctctcgctccctccctctccgactccgtctctctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttccggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctttgg

SEQ ID NO: 48 - DNA, 3759 bp, Homo Sapian
tctagagccgccgagcagacgcccggtgaattctagaggcggcggagggtggcgaggagctctcgctttctctcgctccctccctctccgactccgtctctctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcactttgtttggggagggaagtccctaccatccttgtttagtctatattaagaaaatctgtgtctttttaatat

SEQ ID NO: 49 - DNA, 3699 bp, Homo Sapian
tctagagccgccgagcagacgcccggtgaattctagaggcggcggagggtggcgaggagctctcgctttctctcgctccctccctctccgactccgtctctctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcactttgtttggggagggaagtccctaccatccttgtttagtctatattaagaaaatctgtgtctttttaatat

SEQ ID NO: 50 - DNA, 4757 bp, Homo Sapian
tctagagccgccgagcagacgcccggtgaattctagaggcggcggagggtggcgaggagctctcgctttctctcgctccctccctctccgactccgtctctctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctttg

SEQ ID NO: 51 - DNA, 6049 bp, Homo Sapian
cggccggccggcggtcagccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgccgacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatgttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccggagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtctaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctcctgcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgtatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccatacctaccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctg

SEQ ID NO: 52 - DNA, 1507 bp, Homo Sapian
tcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 53 - DNA, 1416 bp, Homo Sapian
gctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 54 - DNA, 10000 bp, Homo Sapian
cgtttgcttacaggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctcctcgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccacccccatcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggcggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccacctcgtctcccctgccgactcaggcgagtatgtgtgtcgtgcagccagcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctg

SEQ ID NO: 55 - DNA, 10000 bp, Homo Sapian
cgtttgcttacaggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctcctcgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccacccccatcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcaggtgcctgagccggcagggctgggaaccacagagaccctagcaaggatagaggagaaacggcagggcctcaccgtccttgcagcgactcttttggtcctgtccccacagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggcggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccacctcgtctcccctgccgactcaggcgagtatgtgtgtcgtgcagccagcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaagg

SEQ ID NO: 56 - DNA, 10000 bp, Homo Sapian
cgtttgcttacaggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctcctcgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccacccccatcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgagcaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggcggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccacctcgtctcccctgccgactcaggcgagtatgtgtgtcgtgcagccagcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctg

SEQ ID NO: 57 - DNA, 399 bp, Homo Sapian
atgcaacccacgctcagcgccgtcagctcctgcaccgcgccacccagaccgcgaagcagacggtccacccggcctcccagctcccgactcaaccgctccagatcccgcagcacctcggggtcgatggggggaatggccggtgtgggtgtgggtgcaggcgctgggcagggccgcgcaggggcagaaggcgggggtggaggcgcgccgctcagacggatcttgagttgcaggttgttggcgacaaagtgggtaaggtcgccgtggcggctcactgtgccttcgagctccaggggactggagatggtggcgcggcgtccgccgcccgcgccggactcggcactccctgaggacccggcgccaccgcacgcctcgctcagcccgtccaggctgcggctgtcc

SEQ ID NO: 58 - DNA, 3686 bp, Homo Sapian
agcagccagctccccagcaccgcgcggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccaggtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaaccgtgttgctcagacattgctctcacgtggctcaggctttgaggtgcccgttctcggagggatccctgttaacttgcagggtggtagtttcttctcagacccggtggccgataagatgagcctatgcgtgaatcacaaggcccaggccagaggtctcagctggggtccccccagtttgctccatacaaaacgcctaaccgttccatgctcaccttggcagcctccttatttcgggtaaggggtctcagaaacacgtgtttggggtggcaccttccctagggaggcgtttttctgacctagtcctgggacagatttgcccaattctttctgatgctgtcatcccatcccacaccttccacagacttctattctggccccttcaacgtaattcttaagcttatttatatatttggctccccctagtggactgtaagcatattgacaataaaggatcatgtcattac

SEQ ID NO: 59 - DNA, 413 bp, Homo Sapian
atccgaacatggtttttggagagccctctttgtcaacatctgcctgcctgttgcctttaagtacagaatattttgttgcactgttgcgctccgatttttattcatgaaatgacttcctttttttttttctcagtcacgtaatgatcgggtatcagaaaaagacgtcagcatcctagtccctcaaggaacatattaactattctgtgctgtcctcttggatgataagatccggagtcatcgacttctcataaacacctttcactcatacaatccaatttttaagaagtccaattgttttgatggttttcaatttcacccatttcccaaggacagcctcaccaatcggagctctggtctctggaattaagcatcatcaagctctcctattaataaatttaatttagatctcctaa

SEQ ID NO: 60 - DNA, 900 bp, Homo Sapian
atgataacttttctatacatttttttttcaattctaataatggttttatttgttctcggaaactttgccaatggcttcatagcactggtaaatttcattgactgggtgaagagaaaaaagatctcctcagctgaccaaattctcactgctctggcggtctccagaattggtttgctctgggcattattattaaattggtatttaactgtgttgaatccagctttttatagtgtagaattaagaattacttcttataatgcctgggttgtaaccaaccatttcagcatgtggcttgctgctaacctcagcatattttatttgctcaagattgccaatttctccaaccttctttttcttcatttaaagaggagagttaggagtgtcattctggtgatactgttggggactttgatatttttggtttgtcatcttcttgtggcaaacatggatgagagtatgtgggcagaagaatatgaaggaaacatgactgggaagatgaaattgaggaatacagtacatctttcatatttgactgtaactaccctatggagcttcataccctttactctgtccctgatatcttttctgatgctaatctgttctctgtataaacatctcaagaagatgcagctccatggagaaggatcgcaagatctcagcaccaaggtccacataaaagctttgcaaactctgatctccttcctcttgttatgtgccattttctttctattcctaatcgtttcggtttggagtcctaggaggctgcggaatgacccggttgtcatggttagcaaggctgttggaaacatatatcttgcattcgactcattcatcctaatttggagaaccaagaagctaaaacacacctttcttttgattttgtgtcagattaggtgctga

SEQ ID NO: 61 - protein, 437 aa, Homo Sapien [sequence omitted]

SEQ ID NO: 62 - protein, 283 aa, Homo Sapien
MFRMLNSSFEDDPFFSESILAHRENMRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 63 - protein, 268 aa, Homo Sapien
MFRMLNSSFEDDPFFSESILAHRENMRQMIRSFSEPFGRDLLSISDGRGRAHNRRGHNDGEDSLTHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 64 - protein, 4349 aa, Homo Sapien
MTIALLGFAIFLLHCATCEKPLEGILSSSAWHFTHSHYNATIYENSSPKTYVESFEKMGIYLAEPQWAVRYRIISGDVANVFKTEEYVVGNFCFLRIRTKSSNTALLNREVRDSYTLIIQATEKTLELEALTRVVVHILDQNDLKPLFSPPSYRVTISEDMPLKSPICKVTATDADLGQNAEFYYAFNTRSEMFAIHPTSGVVTVAGKLNVTWRGKHELQVLAVDRMRKISEGNGFGSLAALVVHVEPALRKPPAIASVVVTPPDSNDGTTYATVLVDANSSGAEVESVEVVGGDPGKHFKAIKSYARSNEFSLVSVKDINWMEYLHGFNLSLQARSGSGPYFYSQIRGFHLPPSKLSSLKFEKAVYRVQLSEFSPPGSRVVMVRVTPAFPNLQYVLKPSSENVGFKLNARTGLITTTKLMDFHDRAHYQLHIRTSPGQASTVVVIDIVDCNNHAPLFNRSSYDGTLDENIPPGTSVLAVTATDRDHGENGYVTYSIAGPKALPFSIDPYLGIISTSKPMDYELMKRIYTFRVRASDWGSPFRREKEVSIFLQLRNLNDNQPMFEEVNCTGSIRQDWPVGKSIMTMSAIDVDELQNLKYEIVSGNELEYFDLNHFSGVISLKRPFINLTAGQPTSYSLKITASDGKNYASPTTLNITVVKDPHFEVPVTCDKTGVLTQFTKTILHFIGLQNQESSDEEFTSLSTYQINHYTPQFEDHFPQSIDVLESVPINTPLARLAATDPDAGFNGKLVYVIADGNEEGCFDIELETGLLTVAAPLDYEATNFYILNVTVYDLGTPQKSSWKLLTVNVKDWNDNAPRFPPGGYQLTISEDTEVGTTIAELTTKDADSEDNGRVRYTLLSPTEKFSLHPLTGELVVTGHLDRESEPRYILKVEARDQPSKGHQLFSVTDLIITLEDVNDNSPQCITEHNRLKVPEDLPPGTVLTFLDASDPDLGPAGEVRYVLMDGAHGTFRVDLMTGALILERELDFERRAGYNLSLWASDGGRPLARRTLCHVEVIVLDVNENLHPPHFASFVHQGQVQENSPSGTQVIVVAAQDDDSGLDGELQYFLRAGTGLAAFSINQDTGMIQTLAPLDREFASYYWLTVLAVDRGSVPLSSVTEVYIEVTDANDNPPQMSQAVFYPSIQEDAPVGTSVLQLDAWDPDSSSKGKLTFNITSGNHMGFFMIHPVTGLLSTAQQLDRENKDEHILEVTVLDNGEPSLKSTSRVVVGILDVNDNPPIFSHKLFNVRLPERLSPVSPGPVYRLVASDLDEGLNGRVTYSIEDSDEEAFSIDLVTGVVSSSSTFTAGEYNILTIKATDSGQPPLSASVRLHIEWIPWPRPSSIPLAFDETYYSFTVMETDPVNHMVGVISVEGRPGLFWFNISGGDKDMDFDIEKTTGSIVIARPLDTRRRSNYNLTVEVTDGSRTIATQVHIFMIANINHHRPQFLETRYEVRVPQDTVPGVELLRVQAIDQDKGKSLIYTIHGSQDPGSASLFQLDPSSGVLVTVGKLDLGSGPSQHTLTVMVRDQEIPIKRNFVWVTIHVEDGNLHPPRFTQLHYEASVPDTIAPGTELLQVRAMDADRGVNAEVHYSLLKGNSEGFFNINALLGIITLAQKLDQANHAPHTLTVKAEDQGSPQWHDLATVIIHVYPSDRSAPIFSKSEYFVEIPESIPVGSPILLVSAMSPSEVTYELREGNKDGVFSMNSYSGLISTQKKLDHEKISSYQLKIRGSNMAGAFTDVMVVVDIIDENDNAPMFLKSTFVGQISEAAPLYSMIMDKNNNPFVIHASDSDKEANSLLVYKILEPEALKFFKIDPSMGTLTIVSEMDYESMPSFQFCVYVHDQGSPVLFAPRPAQVIIHVRDVNDSPPRFSEQIYEVAIVGPIHPGMELLMVRASDEDSEVNYSIKTGNADEAVTIHPVTGSISVLNPAFLGLSRKLTIRASDGLYQDTALVKISLTQVLDKSLQFDQDVYWAAVKENLQDRKALVILGAQGNHLNDTLSYFLLNGTDMFHMVQSAGVLQTRGVAFDREQQDTHELAVEVRDNRTPQRVAQGLVRVSIEDVNDNPPKFKHLPYYTIIQDGTEPGDVLFQVSATDEDLGTNGAVTYEFAEDYTYFRIDPYLGDISLKKPFDYQALNKYHLKVIARDGGTPSLQSEEEVLVTVRNKSNPLFQSPYYKVRVPENITLYTPILHTQARSPEGLRLIYNIVEEEPLMLFTTDFKTGVLTVTGPLDYESKTKHVFTVRATDTALGSFSEATVEVLVEDVNDNPPTFSQLVYTTSISEGLPAQTPVIQLLASDQDSGRNRDVSYQIVEDGSDVSKFFQINGSTGEMSTVQELDYEAQQHFHVKVRAMDKGDPPLTGETLVVVNVSDINDNPPEFRQPQYEANVSELATCGHLVLKVQAIDPDSRDTSRLEYLILSGNQDRHFSINSSSGIISMFNLCKKHLDSSYNLRVGASDGVFRATVPVYINTTNANKYSPEFQQHLYEAELAENAMVGTKVIDLLAIDKDSGPYGTIDYTIINKLASEKFSINPNGQIATLQKLDRENSTERVIAIKVMARDGGGRVAFCTVKIILTDENDNPPQFKASEYTVSIQSNVSKDSPVIQVLAYDADEGQNADVTYSVNPEDLVKDVIEINPVTGVVKVKDSLVGLENQTLDFFIKAQDGGPPHWNSLVPVRLQVVPKKVSLPKFSEPLYTFSAPEDLPEGSEIGIVKAVAAQDPVIYSLVRGTTPESNKDGVFSLDPDTGVIKVRKPMDHESTKLYQIDVMAHCLQNTDVVSLVSVNIQVGDVNDNRPVFEADPYKAVLTENMPVGTSVIQVTAIDKDTGRDGQVSYRLSADPGSNVHELFAIDSESGWITTLQELDCETCQTYHFHVVAYDHGQTIQLSSQALVQVSITDENDNAPRFASEEYRGSVVENSEPGELVATLKTLDADISEQNRQVTCYITEGDPLGQFGISQVGDEWRISSRKTLDREHTAKYLLRVTASDGKFQASVTVEIFVLDVNDNSPQCSQLLYTGKVHEDVFPGHFILKVSATDLDTDTNAQITYSLHGPGAHEFKLDPHTGELTTLTALDRERKDVFNLVAKATDGGGRSCQADITLHVEDVNDNAPRFFPSHCAVAVFDNTTVKTPVAVVFARDPDQGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSSTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAIWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKLASGVPQLEYHCLGGFYGNLSSQRHVNDHEWHSILVEEMDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQLEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 65 - protein, 221 aa, Homo Sapien [sequence omitted]

SEQ ID NO: 66 - protein, 357 aa, Homo Sapien
MESSRGRPGPETDLLAVAEHQALVFGGGPGRTSSEPPAGLRVSGEEETENVGGANRHPRTSPKTSSCGVVHRPEREALENEPGPQGTLSGAGSRRGAPGAEHEPSLSSRHKNPAPPEGKPSSGRDCRRGGPGGGMDVEQQEEEDNDEEAAAGSRAGRSFSSRLQDSRSLDGLSEACGGAGSSGSAESGAGGGRRATISSPLELEGTVSRHGDLTHFVANNLQLKIRLSGAPPPPPSAPARPCPAPAPTPTPAIPPIDPEVLRDLERLSRELGGRVDRLLRGLGGAVQELTALSVGCIQTYRDAVDSLGEAVDMSIKGMYTLLARCEELERALQPVQGLARQVRDIRRTLEVLEALCK

SEQ ID NO: 67 - protein, 265 aa, Homo Sapien
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 68 - protein, 553 aa, Homo Sapien
MVDMGALDNLIANTAYLQARKPSDCDSKELQRRRRSLALPGLQGCAELRQKLSLNFHSLCEQQPIGRRLFRDFLATVPTFRKAATFLEDVQNWELAEEGPTKDSALQGLVATCASAPAPGNPQPFLSQAVATKCQAATTEEERVAAVTLAKAEAMAFLQEQPFKDFVTSAFYDKFLQWKLFEMQPVSDKYFTEFRVLGKGGFGEVCAVQVKNTGKMYACKKLDKKRLKKKGGEKMALLEKEILEKVSSPFIVSLAYAFESKTHLCLVMSLMNGGDLKFHIYNVGTRGLDMSRVIFYSAQIACGMLHLHELGIVYRDMKPENVLLDDLGNCRLSDLGLAVEMKGGKPITQRAGTNGYMAPEILMEKVSYSYPVDWFAMGCSIYEMVAGRTPFKDYKEKVSKEDLKQRTLQDEVKFQHDNFTEEAKDICRLFLAKKPEQRLGSREKSDDPRKHHFFKTINFPRLEAGLIEPPFVPDPSVVYAKDIAEIDDFSEVRGVEFDDKDKQFFKNFATGAVPIAWQEEIIETGLFEELNDPNRPTGCEEGNSSKSGVCLLL

SEQ ID NO: 69 - protein, 102 aa, Homo Sapien
MCFAIYASESTCQIKVCCLNMITRKAKSLFLDFFSYKPPIDTYPLLYGAQMKDIGHLQHLAQRLQWNRRAVNICGMHGWTKDLSPHSRMPSMLEHVKHYMSC

SEQ ID NO: 70 - protein, 84 aa, Homo Sapien
AKLEQRCHQPQRFPAAPCVSVAQEVRGTLPLQYAELGAVKVLLCQASVEASMGETLSGGRGRGCGKGSSFLQVFLETLGETEQE

SEQ ID NO: 71 - protein, 226 aa, Homo Sapien
MEIPPTNYPASRAALVAQNYINYQQGTPHRVFEVQKVKQASMEDIPGRGHKYHLKFAVEEIIQKQVKVNCTAEVLYPSTGQETAPEVNFTFEGETGKNPDEEDNTFYQRLKSMKEPLEAQNIPDNFGNVSPEMTLVLHLAWVACGYIIWQNSTEDTWYKMVKIQTVKQVQRNDDFIELDYTILLHNIASQFHGIHDSTNSIFTFHLNTSTAIQTFSVPAFQEGKKS

SEQ ID NO: 72 - protein, 222 aa, Homo Sapien
MEIPPTNYPASRAALVAQNYINYQQGTPHRVFEVQKVKQASMEDIPGRGHKYHLKFAVEEIIQKQVKVNCTAEVLYPSTGQETAPEVNFTFEGETGKNPDEEDNTFYQRLKSMKEPLEAQNIPDNFGNVSPEMTLVLHLAWVACGYIIWQNSTEDTWYKMVKIQTVKQVQRNDDFIELDYTILLHNIASQEIIPWQMQVLWHPQYGTKVKHNSRLPKEVQLE

SEQ ID NO: 73 - protein, 532 aa, Homo Sapien
MIQAQESITLEDVAVDFTWEEWQLLGAAQKDLYRDVMLENYSNLVAVGYQASKPDALFKLEQGEQLWTIEDGIHSGACSDIWKVDHVLERLQSESLVNRRKPCHEHDAFENIVHCSKSQFLLGQNHDIFDLRGKSLKSNLTLVNQSKGYEIKNSVEFTGNGDSFLHANHERLHTAIKFPASQKLISTKSQFISPKHQKTRKLEKHHVCSECGKAFIKKSWLTDHQVMHTGEKPHRCSLCEKAFSRKFMLTEHQRTHTGEKPYECPECGKAFLKKSRLNIHQKTHTGEKPYICSECGKGFIQKGNLIVHQRIHTGEKPYICNECGKGFIQKTCLIAHQRFHTGKTPFVCSECGKSCSQKSGLIKHQRIHTGEKPFECSECGKAFSTKQKLIVHQRTHTGERPYGCNECGKAFAYMSCLVKHKRIHTREKQEAAKVENPPAERHSSLHTSDVMQEKNSANGATTQVPSVAPQTSLNISGLLANRNVVLVGQPVVRCAASGDNRGFAQDRNLVNAVNVVVPSVINYVLFYVTENP

SEQ ID NO: 74 - protein, 532 aa, Homo Sapien; identical to SEQ ID NO: 73

SEQ ID NO: 75 - protein, 286 aa, Homo Sapien [sequence omitted]

SEQ ID NO: 76 - protein, 2201 aa, Homo Sapien [sequence omitted]

SEQ ID NO: 77 - protein, 2261 aa, Homo Sapien [sequence omitted]

SEQ ID NO: 78 - protein, 2201 aa, Homo Sapien [sequence omitted]

SEQ ID NO: 79 - protein, 252 aa, Homo Sapien
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILVSRLAHWRNFKH

SEQ ID NO: 80 - protein, 363 aa, Homo Sapien
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILMDVTCDDIAHGQLTVPRSAAVAATGDAKPNMMGRETLLSICASVPKVEFHERHILKHFSFCVCVSVSLFPAKGIVSFSWASFRIWVLWKAVFWQHGESMAVWEGQLGLGLNIAFEYFTSIDVG

SEQ ID NO: 81 - protein, 410 aa, Homo Sapien
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGQIVRYGEIPAELRAAATDHRQELIECVANSDEQLGEMFLEEKIPSISDLKATIRRATLKRSFTPVFLGSALKNKGVQPLLDAVLEYLPNPSEVQNYAILNKEDDSKEKTKILMNSSRDNSHPFVGLAFKLEFLSRSFFRLTRQKDHRRPIQRTTLYLIVMSPYDLLGCNSFLDFPCFSRD

SEQ ID NO: 82 - protein, 374 aa, Homo Sapien
MDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNAIYFKGKWNEQFDRKYTRGMLFKTNEEKKTVQMMFKEAKFKMGYADEVHTQVLELPYVEEELSMVILLPDDNTDLAVVEKALTYEKFKAWTNSEKLTKSKVQVFLPRLKLEESYDLEPFLRRLGMIDAFDEAKADFSGMSTEKNVPLSKVAHKCFVEVNEEGTEAAAATAVVRNSRCSRMEPRFCADHPFLFFIRHHKTNCILFCGRFSSP

SEQ ID NO: 83 - protein, 374 aa, Homo Sapien; identical to SEQ ID NO: 82

SEQ ID NO: 84 - protein, 1541 aa, Homo Sapien
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELAKANMQLLYERLLRRKQLRTQKDNHLEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 85 - protein, 1311 aa, Homo Sapien
MTEVQAMVEFSVELNKFYNVDLFQRGADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 86 - protein, 1418 aa, Homo Sapien
MTEVQAMVEFSVELNKFYNVDLFQRGADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 87 - protein, 1515 aa, Homo Sapien
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 88 - protein, 1352 aa, Homo Sapien [sequence omitted]

SEQ ID NO: 89 - protein, 144 aa, Homo Sapien
MSSSFLPEPLPAKSLQHGVPLSLDSSLSSLLEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 90 - protein, 152 aa, Homo Sapien
MCSLPMARYYIIKYADQKALYTRDGQLLVGDPVADNCCAEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 91 - protein, 165 aa, Homo Sapien
MEPTRDCPLFGGAFSAILPMGAIDVSDLRPVPDNQEVFCHPVTDQSLIVELLELQAHVRGEAAARYHFEDVGGVQGARAVHVESVQPLSLENLALRGRCQEAWVLSGKQQIAKENQQVRARECVMSWKGGSGDAEIQVSILTLIPLGSKGRDTSSGLAEAAPVPD

SEQ ID NO: 92 - protein, 541 aa, Homo Sapien
MPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLVAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISVPLPHIYLAELLQGGQSPFQATASCHIVSVFSLQLFWVCAYCTSICRQGKCTRLGSTCPTQTAISQAIIRLLVEDGTAEAVVTCRNHHVAAALGLCPREWASLLDFVQVPGRVVLQFAGPGAQLESSARVDEPMTMFLWTLCTSPSVLRPIVLSFELERKPSKIVPLEPPRLQRFQCGELPFLTHVNPRLRLSCLSIRESEYSSSLGILASSC

SEQ ID NO: 93 - protein, 918 aa, Homo Sapien
MTSQSSRLLLLKPECVQELELELEGPLLEADPKPLPMPSNSEDKKDPESLVRYSRLLSYSGAVTGVLNEPAGLYELDGQLGLCLAYQQFRGLRRVMRPGVCLQLQDVHLLQSVGGGTRRPVLAPCLRGAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLVAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISVPLPHIYLAELLQGGQSPFQATASCHIVSVFSLQLFWVCAYCTSICRQGKCTRLGSTCPTQTAISQAIIRLLVEDGTAEAVVTCRNHHVAAALGLCPREWASLLDFVQVPGRVVLQFAGPGAQLESSARVDEPMTMFLWTLCTSPSVLRPIVLSFELERKPSKIVPLEPPRLQRFQCGELPFLTHVNPRLRLSCLSIRESEYSSSLGILASSC

SEQ ID NO: 94 - protein, 839 aa, Homo Sapien
MTSQSSRLLLLKPECVQELELELEGPLLEADPKPLPMPSNSEDKKDPESLVRYSRLLSYSGAVTGVLNEPAGLYELDGQLGLCLAYQQFRGLRRVMRPGVCLQLQDVHLLQSVGGGTRRPVLAPCLRGAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLVAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISVPLPHIYLAELLQGGQSPFQATASCHIVSVFSLQLFWVCAYCTSICRQGKCTRLGSTCPTQTAISQAIIRLLVEDGTAEAVVTCRNHHVAAALGLCPREWASLLDFVQVPGRVVLQFAGPGAQLEVLQPGLTSP

SEQ ID NO: 95 - protein, 541 aa, Homo Sapien; identical to SEQ ID NO: 92

SEQ ID NO: 96 - protein, 1278 aa, Homo Sapien
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 97 - protein, 864 aa, Homo Sapien
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 98 - protein, 475 aa, Homo Sapien
MELAVDNVTCMDLHKPPGPLVLMVAVVATSTLSLLMVCGVLILGTKRLAGTVDSRLLLSMKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 99 - protein, 293 aa, Homo Sapien
MRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPV

SEQ ID NO: 100 - protein, 803 aa, Homo Sapien
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 101 - protein, 485 aa, Homo Sapien
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGPPGREPSPSGSAPGQLEGASWNTPLAPQVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGTKRLAGTVDSRLLLSSELGWVSAGSRG

SEQ ID NO: 102 - protein, 475 aa, Homo Sapien; identical to SEQ ID NO: 98

SEQ ID NO: 103 - protein, 3256 aa, Homo Sapien [sequence omitted]

SEQ ID NO: 104 - protein, 2801 aa, Homo Sapien [sequence omitted]

SEQ ID NO: 105 - protein, 2896 aa, Homo Sapien [sequence omitted]

SEQ ID NO: 106 - protein, 500 aa, Homo Sapien
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAPPARCTATPSSI

SEQ ID NO: 107 - protein, 499 aa, Homo Sapien
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFRRPPPLRQPPARCTATPSSI

SEQ ID NO: 108 - protein, 743 aa, Homo Sapien
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 109 - protein, 723 aa, Homo Sapien
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 110 - protein, 723 aa, Homo Sapien; identical to SEQ ID NO: 109

SEQ ID NO: 111 - protein, 992 aa, Homo Sapien [sequence omitted]

SEQ ID NO: 112 - protein, 205 aa, Homo Sapien
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 113 - protein, 205 aa, Homo Sapien; identical to SEQ ID NO: 112

SEQ ID NO: 114 - protein, 4346 aa, Homo Sapien [sequence omitted]

SEQ ID NO: 115 - protein, 3588 aa, Homo Sapien
MKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLAASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 116 - protein, 4347 aa, Homo Sapien [sequence omitted]

SEQ ID NO: 117 - protein, 133 aa, Homo Sapien
MQPTLSAVSSCTAPPRPRSRRSTRPPSSRLNRSRSRSTSGSMGGMAGVGVGAGAGQGRAGAEGGGGGAPLRRILSCRLLATKWVRSPWRLTVPSSSRGLEMVARRPPPAPDSALPEDPAPPHASLSPSRLRLS

SEQ ID NO: 118 - protein, 961 aa, Homo Sapien
MLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 119 - protein, 56 aa, Homo Sapien
LFCAVLLDDKIRSHRLLINTFHSYNPIFKKSNCFDGFQFHPFPKDSLTNRSSGLWN

SEQ ID NO: 120 - protein, 299 aa, Homo Sapien
MITFLYIFFSILIMVLFVLGNFANGFIALVNFIDWVKRKKISSADQILTALAVSRIGLLWALLLNWYLTVLNPAFYSVELRITSYNAWVVTNHFSMWLAANLSIFYLLKIANFSNLLFLHLKRRVRSVILVILLGTLIFLVCHLLVANMDESMWAEEYEGNMTGKMKLRNTVHLSYLTVTTLWSFIPFTLSLISFLMLICSLYKHLKKMQLHGEGSQDLSTKVHIKALQTLISFLLLCAIFFLFLIVSVWSPRRLRNDPVVMVSKAVGNIYLAFDSFILIWRTKKLKHTFLLILCQIRC

SEQ ID NO: 121 - DNA, 201 bp, Homo Sapien
tgtaatggagagccctgctgaagactcaaactgggtgaataaggtcttcaagaagaacaagcaaaagacaagtggcaccagaaaaggcttcccaagacatycgggatccaaaaaaccaagcagcaaagtgcagtgagcatgtctaatgttccttaaatcccacggagaggagcagctttgggaactgtgttcagagagatt

SEQ ID NO: 122 - DNA, 201 bp, Homo Sapien
gtcatcatatccatgaccgagctcatgtcattaaaaagtcaaagaacaagaagactggagatgaagaggtcaaccaggagttcatcaatatgaatgaaagygatgctcatgcttttgatgaggagtggcaaagtgaggttttgaagtacaaaccaggacgacacaatctaggaaacactagaatgagaagtgttggccatg

SEQ ID NO: 123 - DNA, 201 bp, Homo Sapien
tgatatctgaatgttcatgaaggtcctagctttatattgtccctcttttaggaataaaattttgattttcaacaatgtgagtaaattgagtctatttaatrtaaaactctttaaaacatactaattttttaaagcttatatgcttatttcgcttccccagttgtttttgtgttggctaaatattcttttatatttatcaag

SEQ ID NO: 124 - DNA, 201 bp, Homo Sapien; identical to SEQ ID NO: 122

SEQ ID NO: 125 - DNA, 201 bp, Homo Sapien; identical to SEQ ID NO: 123

SEQ ID NO: 126 - DNA, 201 bp, Homo Sapien
ccccaagtacttcctgtccattgagtgcagccggaagagctcctcttccctcagtgacgtgaccacagtcatggtcaacatcactgatgtcaatgaacacyggccccaattcccccaagatccatatagcacaagggtcttagagaatgcccttgtgggtgacgtcatcctcacggtatcagcgactgatgaagatggacc

SEQ ID NO: 127 - DNA, 201 bp, Homo Sapien
tgcagctgatcctgagtgacccagattctccagagaatggccccccctactcgtttcgaatcaccaaggggaacaacggctctgccttccgagtgaccccrgatggatggctggtgactgctgagggcctaagcaggagggctcaggaatggtatcagcttcagatccaggcgtcagacagtggcatccctcccctctcgt

SEQ ID NO: 128 - DNA, 201 bp, Homo Sapien
tccgagtgaccccggatggatggctggtgactgctgagggcctaagcaggagggctcaggaatggtatcagcttcagatccaggcgtcagacagtggcatmcctcccctctcgtcttcgacgtctgtccgtgtccatgtcacagagcagagccactatgcaccttctgctctcccactggagatcttcatcactgttggag

SEQ ID NO: 129 - DNA, 201 bp, Homo Sapien
ctgagggcctaagcaggagggctcaggaatggtatcagcttcagatccaggcgtcagacagtggcatccctcccctctcgtcttcgacgtctgtccgtgtscatgtcacagagcagagccactatgcaccttctgctctcccactggagatcttcatcactgttggagaggatgagttccagggtggcatggtgggtaaga

SEQ ID NO: 130 - DNA, 201 bp, Homo Sapien
gctcccagaactaggaaacttatatttaactggtcagaagaaggtatgcaaagtggagaacagcccctgggttaccccaattgctggccagttccagcttsatgtgtcctgtgtgtctgaatgtgtctgttctgagacatatgagtacctctatggcagcacatgcaggcaaatccagaaccaccaaaacataataatcac

SEQ ID NO: 131 - DNA, 201 bp, Homo Sapien
aactcaagatccgtctgagcggcgcgcctccacccccgccttctgcccctgcgcggccctgcccagcgcctgcacccacacccacaccggccattcccccmatcgaccccgaggtgctgcgggatctggagcggttgagtcgggagctgggaggccgggtggaccgtctgcttcgcggtctgggtggcgcggtgcaggagc

SEQ ID NO: 132 - DNA, 201 bp, Homo Sapien
gtgggcagaggaggccaccaacctgcaggtaaattctccagcagtgaattcactcgatcacacgaagccatttctccagacatctgactcccagcatgaayggtcccaactcctctctaacaaaagttctggaggctgggaagtccaagatcaaggcactggcagattcgatgtctgtgatgtgaatgccaggaaaatcct

SEQ ID NO: 133 - DNA, 201 bp, Homo Sapien
ttgcaggctcttcttggctaagaaaccagagcaacgcttaggaagcagagaaaagtctgatgatcccaggaaacatcatttctttaaaacgatcaactttmctcgcctggaagctggcctaattgaacccccatttgtgccagacccttcagtggtttatgccaaagacatcgctgaaattgatgatttctctgaggttcg

SEQ ID NO: 134 - DNA, 201 bp, Homo Sapien
atatgcaagtgaatcaacttgccagataaaagtttgctgcctaaatatgattactaggaaagccaagtctctcttcctggatttcttctcctataaaccgyctattgatacctacccacttctctatggagcacagatgaaggatattggtcatctccagcatctagcacaacgtctgcaatggaacaggcgagctgtgaa

SEQ ID NO: 135 - DNA, 201 bp, Homo Sapien
ccctgtacctcatcatggccacgggcatgagggaatgatgctggatcatgaccttaaaggaaccatgcagctctatgggcatgaagaagccatgcagtatsatggccatgagggaaccatgaggctccatgggcatgaggaaccatgcagctccatggccataagggaatcatgcagctacagggccatgaggagccatgc

SEQ ID NO: 136 - DNA, 201 bp, Homo Sapien
tacatcaactaccagcaggggaccccgcacagggtgtttgaggtgcagaaggtcaaacaagccagcatggaggatattccaggaagaggacataagtatcrccttaaatttgctgttgaagaaattatacaaaaacaagttaaggtgaactgcacagctgaagtactttacccttcaacgggacaagaaactgcaccagaa

SEQ ID NO: 137 - DNA, 201 bp, Homo Sapien; identical to SEQ ID NO: 136

SEQ ID NO: 138 - DNA, 201 bp, Homo Sapien
cccctcagacatcattaaacatcagcggcctcctcgcaaacaggaacgtagtccttgtgggacagccagtggtcagatgtgcagcctcaggagataacagwggatttgcacaggacagaaaccttgtgaatgcagtgaatgtggttgtgccttccgtgatcaattatgtcttattttatgttacagaaaacccataggaag

SEQ ID NO: 139 - DNA, 201 bp, Homo Sapien; identical to SEQ ID NO: 138

SEQ ID NO: 140 - DNA, 201 bp, Homo Sapien
accattcttcatccaaatggaggcactgaacagggagcaagaggttccatgccagcctactctggcaacaacatggacaaatcagattcagagttaaacartgaagtagcagcaaggaaaagaaacttagctctggatgaggctgggcagagatctaccatgtaaaatgttgtagagatagagccatataacgtcacgttt

SEQ ID NO: 141 - DNA, 201 bp, Homo Sapien
caaattaaaacctagagtagtgcttatgctgaaatgatacttttcattttttggttgatttttttgccttcccttcaattttaaactgaagcattttaatrtgggtagaaactctacaccaaatacactaaacattttggtgcttagtggatttctttttaggtaactggtacttacttccaaagactgaatacaagccac

SEQ ID NO: 142 - DNA, 201 bp, Homo Sapien
gtgtctactagtagttaattggataaactggcagcatccctggcctgttgtcatgcagtcatttcctgttaattctgggagacaatgatttcacaactagmgggaagcagtcctaaaagtttaaaatccgataaggaatatctgggacagggtttagatcatgactctacacagataccatgatgagagtatattaaagaa

SEQ ID NO: 143 - DNA, 201 bp, Homo Sapien
ggctaccagttacatttgacaagtctgtgcaatggatcaaaatcagaagagatgattcaacttggtgaccaagaagtttctgagctttgtggcctaccaarggagaaactggctgcagcagagcgagtacttcgttccaacatggacatcctgaagccaatcctgagaacactaaactctacatctcccttcccgagcaag

SEQ ID NO: 144 - DNA, 201 bp, Homo Sapien; identical to SEQ ID NO: 143

SEQ ID NO: 145 - DNA, 201 bp, Homo Sapien; identical to SEQ ID NO: 143

SEQ ID NO: 146 - DNA, 201 bp, Homo Sapien
ggctaccagttacatttgacaagtctgtgcaatggatcaaaatcagaagagatgattcaacttggtgaccaagaagtttctgagctttgtggcctaccaarggagaaactggctgcagcagagcgagtacttcgttccaacatggacatcctgaagccaatcctggtgagtagacttgctcactggagaaacttcaagcac

SEQ ID NO: 147 - DNA, 201 bp, Homo Sapien
ggctaccagttacatttgacaagtctgtgcaatggatcaaaatcagaagagatgattcaacttggtgaccaagaagtttctgagctttgtggcctaccaarggagaaactggctgcagcagagcgagtacttcgttccaacatggacatcctgaagccaatcctgatggatgtgacatgtgatgacattgcacatgggcag

SEQ ID NO: 148 - DNA, 201 bp, Homo Sapien
tggcgattgggaactctcagttggctcctgtgttcctttaacatcttccaatgttttgcctttttgaatacttccttacttgctggcactacaagacgccycaggcttatcttgtatattccatgccctaaccctagaatcagccgttctccaaggagcactggttcctttttaagtaaaatggtattagaaaccaagatt

SEQ ID NO: 149 - DNA, 201 bp, Homo Sapien
atctcctctgccctggccatggtcttcatgggggcaaagggaagcactgcagcccagatgtcccaggcactttgtttatacaaagacggagatattcaccraggtttccagtcacttctcagtgaagttaacagaactggcactcagtacttgcttagaactgccaacagactctttggagaaaagacgtgtgatttcctt

SEQ ID NO: 150 - DNA, 201 bp, Homo Sapien; identical to SEQ ID NO: 149

SEQ ID NO: 151 - DNA, 201 bp, Homo Sapien
ctcattgggagagctgcacatatagctgttcttgattcggaaatatttttagagaaattctttctggttgctgccctcaaatatttccaatagtataaaarcattgttagcgactggacaattacctcattcaacaatgtttcaaataatgtattatattaaaatgtagatgctgataagttctaagaaatatttatacct

SEQ ID NO: 152 - DNA, 201 bp, Homo Sapien; identical to SEQ ID NO: 151

SEQ ID NO: 153 - DNA, 201 bp, Homo Sapien; identical to SEQ ID NO: 151

SEQ ID NO: 154 - DNA, 201 bp, Homo Sapien; identical to SEQ ID NO: 151

SEQ ID NO: 155 - DNA, 201 bp, Homo Sapien; identical to SEQ ID NO: 151

SEQ ID NO: 156 - DNA, 201 bp, Homo Sapien
agttccttcctgcctgagcctttacctgccaagagcctgcaacatggggttcccttgtcccttgactcttctctctcttccctcctagagaagatctgcayacttcctaacagaggcttggcccgcaccaaggtccccattttcctggggatccagggagggagccgctgcctggcatgtgtggagacagaagaggggcct

SEQ ID NO: 157 - DNA, 201 bp, Homo Sapien
ataattaaatatgcagaccagaaggctctatacacaagagatggccagctgctggtgggagatcctgttgcagacaactgctgtgcagagaagatctgcayacttcctaacagaggcttggcccgcaccaaggtccccattttcctggggatccagggagggagccgctgcctggcatgtgtggagacagaagaggggcct

SEQ ID NO: 158 - DNA, 201 bp, Homo Sapien
tagcaaaggacgtgacacttcatcaggccttgctgaggctgccccagtaccagactgatctcttgcttaccttcaatcagcccccgtaaggaggaaggaaygggcgggtatctcatgactgggttcccaggagaatcgggctgggagggacagaacagggagactcactggtgggatcctccaaggaagcaggagtgggcc

SEQ ID NO: 159 - DNA, 201 bp, Homo Sapien
gttggagaaaagggtttccagatctcacaatgtttattgttgtttccggtcatccacttatgtgcaggtcctgagttttccccctgagaccaccatcagcrttcccctgccccacatctacctggctgaacttctgcagggtggtcagtccccattccaggccactgcctcttgccatatcgtctctgtcttcagccttca

SEQ ID NO: 160 - DNA, 201 bp, Homo Sapien; identical to SEQ ID NO: 159

SEQ ID NO: 161 - DNA, 201 bp, Homo Sapien; identical to SEQ ID NO: 159

SEQ ID NO: 162 - DNA, 201 bp, Homo Sapien; identical to SEQ ID NO: 159

SEQ ID NO: 163 - DNA, 201 bp, Homo Sapien
gacgcctgtaatgccaccaactggattgaatacatgttcaataaggacaatggacaggcaccttttaccatcactcctgtgttttcagattttccagtccrtgggatggagcccatgaacaatgccaccaaaggctgtgacgagtctgtggatgaggtcacagcaccatgtagctgccaagactgctctattgtctgtggc

SEQ ID NO: 164 - DNA, 201 bp, Homo Sapien
tgtcaccgaggtttccccagccaatgttactctgctcagagccctgggccatggtgcctttggggaggtgtatgagggactggtaattggccttcctgggractccagtcccctgcaggtagctatcaagaccctgccagaactctgctcgcctcaggatgagctggatttcctcatggaggccctcatcatcagcaagtt

SEQ ID NO: 165 - DNA, 201 bp, Homo Sapien; identical to SEQ ID NO: 164

SEQ ID NO: 166 - DNA, 201 bp, Homo Sapien; identical to SEQ ID NO: 164

SEQ ID NO: 167 - DNA, 201 bp, Homo Sapien; identical to SEQ ID NO: 164

SEQ ID NO: 168 - DNA, 201 bp, Homo Sapien; identical to SEQ ID NO: 164

SEQ ID NO: 169 - DNA, 201 bp, Homo Sapien; identical to SEQ ID NO: 164

SEQ ID NO: 170 - DNA, 201 bp, Homo Sapien
cctaaggaaaaggcccaggctctagaagacctggctggctttaaagagctcttccagactcctggtcacaccgaggaattagtggctgctggtaaaaccaytaaaataccctgcgactctccacagtcagacccagtggacaccccaacaagcacaaagcaacgacccaagagaagtatcaggaaagcagatgtagaggga

SEQ ID NO: 171 - DNA, 201 bp, Homo Sapien
ttgtgataagttctagtgcagtttttgtcataaattacaagtgaattctgtaagtaaggctgtcagtctgcttaagggaagaaaactttggatttgctggstctgaatcggcttcataaactccactgggagcactgctgggctcctggactgagaatagttgaacaccgggggctttgtgaaggagtctgggccaaggtt

SEQ ID NO: 172 - DNA, 201 bp, Homo Sapien
cgcactcaggaaacgaacaccatcagcaggcaaagccatgcacacacccaaaccagcagtaagtggtgagaaaaacatctacgcatttatgggaactccartgcagaaactggacctgacagagaacttaactggcagcaagagacggctacaaactcctaaggaaaaggcccaggctctagaagacctggctggctttaa

SEQ ID NO: 173 - DNA, 201 bp, Homo Sapien
gtcctgcaaaacagcccctgcttccagcagcaaatctcagacagaggttcctaagagaggagggagaaagagtggcaacctgccttcaaagagagtgtctmtcagccgaagtcaacatgatattttacagatgatatgttccaaaagaagaagtggtgcttcggaagcaaatctgattgttgcaaaatcatgggcagatgt

SEQ ID NO: 174 - DNA, 201 bp, Homo Sapien; identical to SEQ ID NO: 170

SEQ ID NO: 175 - DNA, 201 bp, Homo Sapien; identical to SEQ ID NO: 171

SEQ ID NO: 176 - DNA, 201 bp, Homo Sapien; identical to SEQ ID NO: 172

SEQ ID NO: 177 - DNA, 201 bp, Homo Sapien; identical to SEQ ID NO: 173

SEQ ID NO: 178 - DNA, 201 bp, Homo Sapien; identical to SEQ ID NO: 170

SEQ ID NO: 179 - DNA, 201 bp, Homo Sapien; identical to SEQ ID NO: 173

SEQ ID NO: 180 - DNA, 201 bp, Homo Sapien; identical to SEQ ID NO: 171

SEQ ID NO: 181 - DNA, 201 bp, Homo Sapien; identical to SEQ ID NO: 172

SEQ ID NO: 182 - DNA, 201 bp, Homo Sapien
aggagcggctttttaaaaacgcaaggcacaaggacggtcacccgcgcgactatgtttgctgatttttcgccttgccctctttaaaagcggcctcccattcyccaaaagacacttcccctcctccctttgaagtgcattagttgtgatttctgcctccttttcttttttctttcttttttgttttgctttttcccccctttt

SEQ ID NO: 183 - DNA, 201 bp, Homo Sapien; identical to SEQ ID NO: 182

SEQ ID NO: 184 - DNA, 201 bp, Homo Sapien; identical to SEQ ID NO: 182

SEQ ID NO: 185 - DNA, 201 bp, Homo Sapien; identical to SEQ ID NO: 182

SEQ ID NO: 186 - DNA, 201 bp, Homo Sapien; identical to SEQ ID NO: 182

SEQ ID NO: 187 - DNA, 201 bp, Homo Sapien
caaaagtttcttcgtcttatctttgggaccctagttcaaaggtggctagaggtgcaggtagctaatttaacaagtccacagcgctgggtgcagtacctcckgcttcttcaggagtccatctggcctggtggagttttgcctaagtttccacggcccgtaaggacccaagagcagaaactggctgctgagaaacaggctttg

SEQ ID NO: 188 - DNA, 201 bp, Homo Sapien
agtaggctacagctaagaaggcctaggttctcggtggctcacttctctcccacttctgctccatttgtagcaggtgacaggggtctgtgtgtcccagttgyatgcacgtttatttccctgttccttttgtgatgttgggattgttgctggtgagtagatcctgtttcctttgggaaaagaagctgtgaggtagaggaatga

SEQ ID NO: 189 - DNA, 201 bp, Homo Sapien
aactgcatgacaagctgcatattcagcctcagtttttccaaggagaatggaaagcacttgcctcctgtcttaagaatgcacaaagagtaggactagcaagsctgggggatgaaatctcccttcctaagtctttgacagagaacttttattattctgaacagataagattagcaaacttacaaggaatagcttcttatttcc

SEQ ID NO: 190 - DNA, 201 bp, Homo Sapien
gctagcaagtctaggctgaggttctcatccagtaaaatttctccagcactaagtgtgactgaagcacaagacaagattctttattgtctccaggaaggcartgtggagtctgagactctatccatgtctgcgatggaatcttttattgaaaaacagacaaagttactggaaatgcagccaacaaaagccccagaaaaagat

SEQ ID NO: 191 - DNA, 201 bp, Homo Sapien
agaggttgaagaaggccacgaagctgtagagggagatttgggtgggatgtgtgaagaaagaaaagtaggaaacaactcatctcatttcctacagccaaatsttcgaggtcccctgttcttatgtgaagactcagagctggagtctccgctgtctgaactgggcaaagaaaccatcatgctcatgactccaggcagctttct

SEQ ID NO: 192 - DNA, 201 bp, Homo Sapien
gttctgctgcctggggcccaggggctccctggtgttggcctcacaccttcagctgcccagactgcccgtcagcaccccaagatgcatcttgcccacagcamcctcaaacctgctgctcacctcattggagaccccagcaagcagaactcactgctctggagagcaaacacggaccgtgccttcctccaggatggtttctcc

SEQ ID NO: 193 - DNA, 201 bp, Homo Sapien; identical to SEQ ID NO: 192

SEQ ID NO: 194 - DNA, 201 bp, Homo Sapien
tcaggctaccccactcctgacatcagctggagcaagctggatggcagcctgccacctgacagccgcctggagaacaacatgctgatgctgccctcagtccraccccaggacgcaggtacctacgtctgcaccgccactaaccgccagggcaaggtcaaagcctttgcccacctgcaggtgccagagcgggtggtgccctac

SEQ ID NO: 195 - DNA, 201 bp, Homo Sapien; identical to SEQ ID NO: 194

SEQ ID NO: 196 - DNA, 201 bp, Homo Sapien; identical to SEQ ID NO: 194

SEQ ID NO: 197 - DNA, 201 bp, Homo Sapien
gctcctgcaccgcgccacccagaccgcgaagcagacggtccacccggcctcccagctcccgactcaaccgctccagatcccgcagcacctcggggtcgatkgggggaatggccggtgtgggtgtgggtgcaggcgctgggcagggccgcgcaggggcagaaggcgggggtggaggcgcgccgctcagacggatcttgagtt

SEQ ID NO: 198 - DNA, 201 bp, Homo Sapien
cccagtgggcttcacagggcccatggtgcagggtgttgggatcagttttgccaagtcaaacaagcaggtctgcactgacattgatgagtgtcgaaatggascgtgcgttcccaactcgatctgcgttaatactttgggatcttaccgctgtgggccttgtaagccggggtatactggtgatcagataaggggatgcaaagc

SEQ ID NO: 199 - DNA, 190 bp, Homo Sapien
aagatccggagtcatcgacttctcataaacacctttcactcatacaatccaatttttaagaagtccaattgttttgatggttttcaatttcacccatttcycaaggacagcctcaccaatcggagctctggtctctggaattaagcatcatcaagctctcctattaataaatttaatttagatctcctaa

SEQ ID NO: 200 - DNA, 201 bp, Homo Sapien
aatacagtacatctttcatatttgactgtaactaccctatggagcttcataccctttactctgtccctgatatcttttctgatgctaatctgttctctgtrtaaacatctcaagaagatgcagctccatggagaaggatcgcaagatctcagcaccaaggtccacataaaagctttgcaaactctgatctccttcctcttg

SEQ ID NO: 201 - DNA, 10000 bp, Homo Sapien
ccaccatgcccagcttctgtctatctcttggacccctaggagcagtgtgaggatgttctctgactttgcttccctcccggacagcgctggcaccttctgggagctgttggaaggtccatcctaccttcccatgcctcgccttccctgtggccatgttcctttaggagcctctgctcctcattcagaaggagagtgaccctttggacacacctgacttaccaagcttgctgaacttgagactcaaggatgctcacacctcttatgtcactgctgctgttttaattctgtagatgggtagctgggacacacacaggggaatataggcctcactcctcttaaagctggaaggcatccttaagcctacctggtcttcattttacagacaaggaaacagaccagcaaaattaaaagaccaaggtcagccaactaagaaactgtggcataattctgagacaaggatctggccaaggctttgtttatgggctccacagcatttcaagactccactggcctattctgtatcgtgttcctctctcagtggctgtggctctggcatttctggataggaatgtcctgaagagcagaagcagaggggagttcccagagacaaactgcttggttgctgggcatagaatagcttttcccctgtccctactcctatcccattctggtcctacctggctcctatgcttgtctcggtgtggctgaggactcgggtctcttgatcacttcctccacggggcctttgacagccttgtcattgaagtcaaaaaagtgtcaaagttctcattttggcctaacactgacaaagtactgccaatgtgctgataatccttgtattacgtgttggggctgcaaagacacacacccctggtctcaagacactcacaacctgatttataagatacatctcacataacgccgcataaggccagtgtgagggtcccagatatgtggaggcgtttgggagagacatgtttggttggggagtaatgaaagccttcagaagcagcaattaattcaagccttgacaaatggggttaggaaagactttatttatgaattgtaagttgaattacaaagacgtttgcaaaatatttacaaaatatttagggtgaaattacaagctcattctataaaccattttagaaataaaagtggccagatgggtaggattttagcaggcgaggctaagaagaggagacaaagtcatggctcagaaagagattgtgcatattccagctccagtgactagctgacctcccacgtgactggaacccaccgaggtggcgagcagtatatcgggcttaaaagccctgtcactgtcactcactctgtgaccctgggcctctctgagactgacgtaataaaggatcccaaagacagggcaaggtgggtgccattcatatatggcaggtagcagcatccattgaaagatttgaacagggcagagacttgattggagcttggcaactaactaaacatcaaagttaaaaagcaagagtgttaagacaggatgctgggtggctgctggagggatcgctgtgggttttgaagggaggagaaagtgtaggttttttgatgagtttgtgttgtctatgggacatctaagaaatacctccagcaaacagatgggagttgagcccagaattcaggagaaagatgggagcagatgacagagatgtgggcacagtggagcccacctaggcagttagaagaatggccaaggacagcaaggaaggcgaaggacagacatgaggaaagccccttacacttagagtctggggttgggggaaagggggagacagcaccttttgaggggtctgttctccagggagggcctcacagggaatgtcaagccctcatgccacagatggaggagaaaggcaggtcagatgtgcttagcatcacaaggcaggaaaaggcagggctggaccagaactcagcacccactcagccctttctgctctccacggacttatatattacccaaagtaggcaaaagtgtccttaataaattttatcaatgatgtgactgaaattcatgaactcaagtctaaaatgatactgtaatattgggacatgtgttggagacactctgactctcggaatagagaatcccattctcctaacaagttaaaaaatatcattgaaagcatttgccaaaatcccttgtcagcttggctgcttccattaatatattagatgccattagcacctgagtgtgaatgtgccagtgcgtcagatgggctctcctgacctggctaggctctgagtttcacttttagagaagaggtggggctagtggcaagactgccaggctcggagtagtgctgaaggagagagggagggtgtgggccttgactaccctgagtctgcaggcctcccacagtgtctgcagtcgggcaatgagtgtgcaggtctctggtcctgctggctgcagccttctggcctctactgaagctgggatgagggaaggaggtctttggaggagggaagtggtttctccaaaaggtggggcagaagtttcttactctgtgatgaggaagaagggccagggagatacgtgctgggctagagctggagaggagtgctggatccaccctggtgatacgagagaagggcagggaagtgctgggtagagaagaatggggtccctggtgagggcttcaccctcaggcctggtccacggacctaggtgaggacaggcacccttgtttttgagcccaaatgttgcattttccaagaccactctggcccgccacgcccctgatcctgggcccgtaaaaaccccgagaccctagcgggcacacacacacagccggctggaagtccagagaagcagaacacaccgaaaggcaccaacagatgccgacaggctatcgacgacgccacgatgacgtgaaatttggcacagcgcggtcggagtccagctgccgggcagcccaattccaggtgaagaccaccttcccactccatcctccttctggcctccccattcacctcactgagagctacctccactcaataaaaccttgcacccatcctccaagcccacatgtgatcctatttttctggtacaccaaggcaagaacccaggatacagaaagccctctgtccttgtgataaggcagagggcctaattaagctgattaacacaagctgtctgcggatggctaaactagaagagcataatgtaacacacacccactggggcttggggagctgtaaacactcaaaccttagacgctgcagtggggtcggagcccacactccccatgacctgcctgtctgcatgctcccgctaggggtttgagctatggggtaccaaagaagtgagccacacccccattgcatgcccagcgagggggataagagaacttttcccatttcactggcacctggggtgaccttctgtctgccctttcccttcgagggtggcagaaggtaattggggatagacgaaaaacgtccgtgtgtgtgtgtgtgtgtgtgtgtgtacatatacataagtattctcttcaactttaatagggccaggactcacgggctacatgcagtcaaacactctactactgagctctacccccatcacaggctacatagagtcaaaaaagctagttgtccccaaatttcagaagggccgtggtgctgtttctgagaacattttatgtcctttgcttgacacctgtaaggctggttggaagagggtggattcagttgaactcctgaagccgtgtctcaatcccttcctcttcctttctgcctagtattcgtccgtttgggggatagagaagccatactggggatgcgacgttgatggttcctcatgggcagggagtatcacataagggtccaggggtgggctccttcccttcagcttcacagtccagagtgacgcctgaaggagattttatctaagctggtcaggaaagattataaaatccgtgggggttttttgtatgtaatatgggaaaatttttaagtgcaaagaaattaagaactaccctttttctgaccacacagaaactaccattttaatgtaattccttatagtctcttgttttttctaggtagagcatgtattttagtttcttgtactaggtagttgagtagtctgttacctctctgacatcactgcggaaattcatggtacgactgggatgcaagtcctccccacgcctcctcagcctaagtctggctttttctcacttgctgttgttcatggactggcctaaaccaagcattgcctgttagttcctctgttttgttaaaatactgatagtctccatagcatttgaaattagatgggagctatatatcttcctcccaacaactttgctctcttgggtaaatttccatggaattcagtcctagaccaaattctgccccatgtacaaacatctaatgagtgaggaagccaccatatggccatataattctcctcttgattgagaagttcccacctctgcttttgggtacagccaccagcatcgggaacgaagatcactccacagcagatacaacatgcttccgaggtcaggaccagttagtggagtagtcaggtcaggagcaggaggaacagaccccgaagtttgagtattttcatattttagatatagttttacatacagtaactctgggacacaaatcttaagattaatctctatgagtgtttatatgtgtacccacccatgaaattgtgatccaaatcaaaatacagaatgtttccagtgccctagaaggttcctcatgaccctgtccagtcaggacccctgctgcaagtgtaactaccatccagacttccattgctgtgggttagtgttgcttgttcttggacttcacataaatggaatgacacagcttgcgctcttttgtgtctggcttctttcatttaacattgtggctctgagctccaccctgttttgcatgtagctatagtttgctttttgttgttgctgagtaatattccatcatccaaacacaccacagtttgggtatccattctcctgctgatgggcactgggttatttctagtttagggctgttataaataacactgctgtgaacattcttgtacatgtcatttgatggacataagtgcttgtatgtcccaggagtggaattgctaggtcacggggcagatatatgtttagctttagtggattctgccagtttcccatttggtgttcaatttatatcccctcctgtatgagtctgatcttgcacagctccccacctgtattagtctgatctcgcacagctataaagaaatacctgagacttggtaatttataaagaaaagaggtttaattggctcacggttctgcagactgtataggaagcatggctggggaggcctcaggaaacatagaatcatggcggaaggggaaggcgaagcaggcacatcttacatggccaaagcaggaggaagggagcaaagtgggaggtgctacacactttaaaataaccagatctgagaactcactatcgtgagaacagtaagggggaaatctgcccccatgatccagtcacctcccacccggcccctcctctaacactgggaattaaaattcaatatgagatttgggtggggacacatatccaagccgtatcagagtatagttgcttcacatctgtgccaacacacagtactgctggtccatgatgtttgctccagacctgcttgttgaatgacttccattaagctccactgtgcagccaggcttctgttatcctttacagcactttctggctttagagggagaattatgaactgccaaggtgcttttcaactggggaaccctgattgagaggatggtgaggggggagagctccctggagtggatttgctgctgatcctgtcctggactccagggcatgtatgcacctggctgtgcagcccaggcctctcttggcacccacttctgtactatggtgccacccagatccctgcatgggctgtttgggagatagggtcacactgggcagtcctttttagttcagagtaacactacctttcccacctcatcctcctcatcactgtcattgggctctgagggacccacttttgctcgaggattgcttttttactttctgtttttgttttcttgagatagggtctcactctgttgcccaggctggagtgcagtggctcgatcacagctcactgcaatctctgcctcctggggctcaagcgattctcccccctcagcctcccaaatagctgggaccataggtgtgtgcaccaccatgcccgactagactaattttggtattttttgtagagatggggtttcgccatgttgctcaggctggtcacaaactcctgggctcaagggatccgctggccttggcttcccaaagtgctgggattataggcgtgagccactgtgcccggtctgagggacccacttttgaatacagaccccagcctgtgtcctgaggtgttatggttaccggtggggcagaagggacccctgcatattgcacccattttgtccttgtccactggctgttgcccaaaattctacccttagtgctttatgcttttacctctcaagggcatgatacttagggacttggcagtgaccctggttagagtgggcctgttttcctttaaatgaccggtatcccagtgtgaacaaaggatatgtgagcaggttttgataaggcaatacagcaaggacactgagtccttgaggggaaggtttaaaaggagatgaaaagggcctacttgctgttggctgaccttggtgccacagacgcacatttcagagtcatcaaggatgaaggctcagaagactctgaagcaacttcaaaggaatcgcttggatcacaggtggggtgaaggttggagataagaaggcagggccagggaaagagacccaagggagcctcgtttggaagcaaagctctggaaacaaaagactgcagagccagggtcaacctgggcaactgtttgaagccagccccgtcctcaggtgcaagaaagagcattctctgggtctaagcctgagttgtgcgcggaggacacaggctttcctgggcaggactgcaggcttctggctccactcgtgcctgtggcacacacaggttttgatagccagagcctggccagtcctcctctttctgctccctgtccctcctgggaccaggacttggcctctcccctccaccctcccttctcttcctccttcccttctttgtctccttctccttaaattttgtgatttttaatttcaattgatttattgcccctccttgtccccagcctcccagttctcctccccagaggaaaccagtttcaccagttgcatgtgtaagtttccagagacactttaatctatgcacatgagtgatgtgtgtgtccactttttctatacaaatggtagcatactttttatagtgttctaggcctcatttaaaattttaaaattaaatattgagtagatacaaaaatagtagttatagaatatatatacattttaaagacacccacaatacaatagaccagtatgggtacccacgccctgttttagacaaagaagctgggcttttgaaaccatgtgcctctctccagccccaccctcctcttcccctaaatactatcatgaattttacgcttatcctgccctttttgtctttttataatcctactacttgtttataatagattatgataaatatactatatttttatactaagataaatgtaataaacattatatataacaagacataaatatatataataattgaatatggtatactacctttttgggattatgaatagaatagttttctatggctggcttttgtcccacccataattatagttctgaagttcagtgtactgatacgcatgtccggagttagttcattttcactcttgtatagaattccattgcatggagatagtatgattattttcattggactattttatttattaataataattattattgttttctaatttaattttattttttgagacagggtctcattctgttgcccaggctggagtgcagtggtgcaatcatggctcactgcagcctcaacctccagggctcaagaaacgatcctcctacctcagcctcccaattagctgggactacaagcatgagccatcacacctggctaatttttaaaacttcttttatagagacaaggtctcactatgttgcccaggctggtcttgaactctcaacctcaataatcctccggcctcaggctcccaaagggtggctcatgcctgctgggattacaggcatgagccactgtgcttggcctcagtgctggcctcagttttggggttctaggaacagagctggtgcaaatgttcttaattgtttcttttggtgtgtgttggggggaatggcgggggttgggtaagaacttctccagggcatttgcaaggccattgggaaagtacattgtcaacttcagtagataatgccaaaattttaaaaagtggttataaccattcgcacacccactagtagtttgagcattcccctcactccacttcttcaccaacacctgcaattatcagcttttttttttttgtagatggatctgtgtgaaattgtaactcactgtggttttagttttcatttccctggttatgcatgctgccttttttttacttaaaatatgtcttggtgactgttccgtatcagagcagtgaggacttcctcctcctttcttggctggaaagtgttccatcgtcatatggaaatcttgtggtcgatttaacccgttccctattgatagacgctgtgtgggctccagccttttgcagtcgactctgcgatgcataacttcgtgtatagatagcagtctgcagctgcacgtgggggtgtgtgcatgtaggtttttcacaggaacctcctgaaatgcttagaagaaaaggaaagatagtgtttgctcccccggccctgtgcctccctattttcaacaaattcccttaattccatgagtgccccagggtcagaatggtatccaccctgtcctgtttgcaccgtaccatctcttctctcagatgatgatgttcatctcccacccgcttcccttcgagccacccccacctcatagactcctcaggaattgtctctacccggcatctctcactttttcttttcttttttcttcctttctctctttctctttcttccttccttcctttccttccttccttcatttccttcccttccttccttccctttctttctgtttctctctctctctccccctcccttcctcccttccttttctttccttctttctttctttcctttttttttttttttttttgatcagggttcttgctctgtcacccaggctggagggcagtggtgcgatcatggctcactgtagcctcaaactcctggactcaagcgatcctcttgcctcagcctgccaaatagctaggactgcagctgctcgccgccatacccagctatattttttgtagagacagggtctcgctatgttgccttggctggtctcaaactcctaggctcaagaaatcctcccccctcagcttcccaagtcactgccagacatctttcttattgacatccccatctcgagaatccaagttagtattaactgagggattagactttgccttgccctgaaagagagaaaaacaaactgaccaccactctagagactgtttagtctcaaaagtcggcgcagtaacacacacacacacacacacacacacacacaaccaaccaaccaaaaaaaaaacaggtaaaggcagacaaattccaacccatcccctatgtgctgtgccctgggcaaaccctctgacatccttcagactcagcttcttcctctatgaaaagggacaataacacttacctcttgtgggtgtggggcagatgagggccaatgttaataaaccactcacattcatgcactcactaatcaaagctttcattgttatcaaggataattctaattcaagtaagctatgaagatggcatga

SEQ ID NO: 202 - DNA, 10000 bp, Homo Sapien
aactttaatgtaataatggctacataaaaaaaacccatagctaacatcttactgaatggggaaaagctcaaatcttttcctctaagaactgatacaaaaacaaggattctcagccttaccactcttactcaacatagtactggatgtcccaggtggagtaattaggcaagaggaagaaataaagggcatgcaattggaaaggagggcatcaaattgtcctgttagcagatgacataatcttatatatacagaaaacctaaagactctaccaaaaaactgttaaaactaatagaggaatttggtaaacttgtaggatacaaagttaatatacaaaaatcagtagcatttctattcatgaacggtgagctagctgaaaagaaatcaagaaggcaaccccatttagctataaaaaataagataaatgcctaggaataaatttaaccaagggaataatagccctctatagggaaagctataaaacaatgatgaaaaaaattagagggtacaaacgaatgaaaaaacatcccatgcttatggattggaagtattaatattgttcaaatgacaatactacccaaagtaacctacagattcaatgcaattcttattaaaataccaatgacattcttaacaaaaatagaaaaaaaaattctaaaattccttgtggaactagaaaagaccctgaacagccaaagcaattctgaggaaaaaagaataaagctggaggtgccaaactaccagacctcaaattatgctacaagctgtagtaacaaaaacagcatgacactggcataaaaatagacatatagactactgaaatagaatagagaatccagaaattaatccacatactcacagccaactgatttttgacaaagctgccaagaataatcactgggaaaagaacagtctcttcaacaaatggtactgggaaaaccggatatccatatgcagaagaatcaaactagacccccacctcttaccttagaaatcaactcaaaacagatgaaagacttaaatgtaagacctaaatgataaaactattattaatagaaaaaaacataggggagacatttcaggacattggtatgggaaaagattttatgaatgaaacattaaaagcacagacaacaaaaacaaaagtaaacaaatgggattatatctaactaaaaaattttctgcacaacaaatcaaacagagagtgaaaagaaaatgtacaaaataggagaaaatgtttgcaaactgcttctctgacaagggattaacatcccaaatacataaggaactcaaacattttaacagcaaaaaacccaaacaatctgatttttaaatggacaaataatctgaacaaacatttctcaaaagacaacatgcaaatggccaaaaaatatttgaaaaaaaaatgttcaacatcacccatcatgagggaaatgcaaatcaaaaccacaataaagtatcatttcacccctgttaagatggctattattaaaaaagacaaacagtaacaaatgctggagaggatgcagataattgaatttaagattatccatattgaccaattgctatccccaagcaactgcagctagaagaacaacataggaatcctttttgagagagagagagagaaaaaaaaaaaaaccttcaatacaggacgaaataattcttggctgggtgcagtggctcatgcctgtaattctaacactttgggaggctgaggcgggtggaacactggagcccaggagttcgagaccagtctgggcaacatggcaaaaccctgtctctacaaaaaaatgccaaaaaaaaaaaaaaatagccaggcatggtggcacctctagtctcagctactcagaggctgaggcaggagaatcacttaaatccaggaggtagaggttgcagtgagcagagattgcatcattgcactccagtctgggtgacaaaaaattaaaaaaaaaaaaaaaggattcccacagataaaaagtccaagggaaaaaaaaaatgagttcatagaaaaaaattacaggccgggcatggtagctcacgcctgtaatcccagcactttgggggtttgggtgggcagatcacctgaggtcaggagttccagaccagcttgaccaacatggtgaaaccccatctctgccaaaaatacaaaaattagctgggtgtggtggcgggtgcctgtaattccagctactcaggaggctgaggcaggagaattgcttaaacccaggaggtggaggttgcagtgagccaagatcgtgccactgcactccagcctcggtgacaagagaaaaactctgtctcaaaaaaaaaaaaaaataaataaataaataaataaataaaaaactacaaaacacagggaaacaagcaacatgagtaaaaccggtagaaacaacaaacatagaaatagtcttcaaataattagaattatttgacacagaaaatattatgcatatgttaagagtaataaaagagcaaaatgaaaatttgagcaggaaacaagagactatagataccaagcaaaattgaaaaaggaccaaatagaacttgtagaaatgaaaaataactgacattaatgacatagcagaagggttaaaaataggaataaacagagctaaagagagaatatcactttagtgataggtagagctaaagaaactatcccaaatgcagcctgaaaagacagaggtaggaaatatgaaaagattaaaagacatggaggatgttatggactgaatgtttgctcctcacctcccctccgaaattcgtatgttgaaatcctaacccccaatataatggtactagcaggtggatctgtgggagctaattagttaataagggtggagccctcatgaatattaatgcccttataagaggggccagagagagttctctagtgctccttccactatgtgaagatagaagaagtcggcaatctgcaacctgaaagagggccctcaccggaacccaaccgtgatggcatcctgatctcagacttccagttgccagaacaatgacaaatacatgtttgtcatttaagccatccagactatataatttgttatagcagcctgaactaagatgcagataatgtgggaagatctaacagatatcttttgggagttccaaaaatagataacagaattagaaagaagccctattcaaagcaataatggttgataattttccagaattggtaagacatcaagtctcaaacccagtaaccttaatgactcctaagtatgataaataaatccacacctaaatatatcccaattttaaaaaaagtgaagagtatcaaagacaagttaaaaaatcagcaaagcggctgggcatggtggctcatgcctgtaatcccagcactttcggaggcccaggtgggcagatcacctgaggtctggagtttgagaccagcctgaccaacatggagaaaccccatctctcctaaaaaacaaaattagccaggcgtggtggcacatgtctgtaatcccagttactcgggaggctgaggcaggagagttgcttcaacccaggaggcagaggttgtggtgagccaagattgcaccattgcgagactctatctcaaaaaaaaaaaaaaaaaaaagtatcagcaaagctgccagaaataaaaagataaatcctctaaggaggaacaccatcatactggttgcatattttttcatgagcaacagtgaaatctaaacaccaaggaagtactctatttagtattatttgggagaaaacaattgtaaaattacaattccattaccaacagttttgctcaattagtgggttaaataacaacaatttcagataatctccacttcaaacctggttcaatttaactgtgaaaatagtctttttttttattatactttaagttttagggtacgtgtgcacaatatgcaggtttgttacatatgtatacatgtgccatgttggtgtgctgcacccattaactcgtcgtttaacattaggtatatctcctaatgctatccctctccccctccccccaccccacaacaggccccggtgtgtgatgttccccttcctgtgtccatgtgttctcattgttcaattcccacctatgagtaagaacatgctgtgtttggttttttgtccttgcgatagtttgctgagaatgatagtttccagcttcattcatgtccctacaaaggacatgaactcatcattttttatggctgcatagtattccatgctgtatatgtgccacattttcttaatccagtctatcgttgttggacatttgggttggttccaagtctttgctattgtgaatagtgccgcgataaacatacgtgtgcatatgtctttatagcagcatgttttataatcctttaggtatataccctttctcaatgaacttccaaagaatatagttcaggccagacacagtggctcacgcctgtagtcccagcactatgggaggctgaggtaggagtactgcttgagtccaggagttcgagaccagcttgggcaacatagtgagaccttgcctctacaaaaatgcctaaaaaattagccaggcatggtggcacttccctgtagtcccagctactccagaggctgggactctcaagaaaacaaaaaacaaatatagttcaggaaggaaaaaaaaaagatctcagatggacggtctggggtacaaaaagtggatggtgagcaaaagtattgtgggaaaatattttaaaaattgatgatacagaagaatatttaaaatgatgaatttgatactacatgatctcattcatatatggaatctaaaaaagttgatctcataaagagtagaatagtaggtggggcacggtgcccacccctgtaatcccaacactttgagaggccaaggcaggcagatacctgaggtcaggagtttgagaccagcctggctaacatggtgaaaccccgtctctgctaaaaatacaaaattagctgggcgtgatggcgggcacctgtaatcccagctactcgagaggctgaggcaggagaatcacttgaaccctggaggcagaggttgcagtgagccaggatcgcgccactgcactcctgacggagacagtgtgagactccatctcaaaaaagaaaaaaaaaaaagagtagaatagtgggtcaccagaagctagggacagtagggaagatgggaaaatggggagaggttggttaatgtacaaagttacagttagaagttctaattattgcacagtatgatgactacagttaacaaataatggattgtatatttcaaaataactagaagagaggattttgaatgttctcaccacaaagaatcaataagtatctgagggataagtatactaattatcctgtcttgatcattacacggtgtatacatgacatgtatcaaaacatcacactgtcaaaattaaaaaatgaatttgaatacaatcaaacaatccaactattccagggcataagaagcttgctcctttagactctgcctttctcacctccacactgcattttgaactgctgtctacttttttgcacatttttccctgtgctctgaccacagccttctcccagtgtcagcctccatatgcatggtaaagaccctctcctgtctcttgtatgtaacttagatgttacttaccatgaccctggattaaaataattggtagaatgggcctggatgatccagaaacgttagagaaagaactgaaaaatatgtggccatccatatggcaagctatccagtgccttaattttagagaaaatataaaatgttgattacattcttcttgcaaagtatgcgaggcagaaaaccattttgtttttcgaagtcaactactaacttgcattagtctggtttctctgagaagcagatgccaagaaaggattaaatgatcaaagattttattaggagaaacacctgagagagaaaatggaggtagctaggtaaggttgagagggccaccagtcagtcatacaagtttgatcccgagtgaaagagagagggaaggaagagttggtgaaagcatcctatactgcctttcactctccagaaattttggcaaggccactggggagttcttgagccaaagtcagatgtcagagtccaacaactctcaggaacagacctatccctgcaggacttagtcactgactgggagcggcccatgggaagaccattctcagagaaaatgcacagatggatcagaccacagccagccaacccctctatcaactaaatcccctgtagttggccagccaggtgtagtctcttggtcaccacccaagcaaacatctgggctttgaaggaggagattcctatacatatgtaaaagaagaaatttcagcctggtgatatcattattgatcacttcattgacaggacaatcacaagttctcagatcttctatgacaggagtcattcctgtgccatattccaaagcctaaaccaagctgcccccaaactaaagaggttctctgcaactgccaagaagctaggactgtgatgtcactcaaaggggacaacggacacaaatgtaggcctctgttttagctcctgagcagaaatattcttgttctatactgaaggggtggatattatacgactacaattccagaggtggaattctagaggtaataagctggaatttactataccagcattgccatggctacagacagtgattgctacaaggagcatgaatatgcagttaatagagttttgaagaccctgacagaaaatgcaaataagatcttaaacttactcttcacttatcatatcacatatagggttcatggaatattcaaaacctctttattacgtgaagaataagagccaattttgttagattacaagacattaaaataacatggctgcccaggagaaaagattataatttcagtcacattgggatacttaacttgaaataatgtgataaatacatgtagtttcatgtcttgctcatttaggaagaactaatgatatgacaagtaatggcttacattggaagctcctacaagacctacgctgcttaaaatatacagaaaagcaaagcaaatcagctgtaaacatatggaaaaagatcatacttcattaattatcagagaaaaagtgcaaaattaagataaggaggtaatattttacctctattaaaatttgtaataataaaagtttgagaggtaacctccaccattctctttgggcaagggatatgaaaaaaatggacatttccgggacattcattggtatgactataaataagtacaatctttctgtaatttagtaaaatgtatcaaaaatttaaaaatagctatactctttgaattggtaactctgttcccataatttatcttaaacaaattatcagcaatacagttatgtataaaaattatattcatacaaatttacaatagcaaaaatttaaaacaatctgaaataccaaatatttggaggtaaagtatggtacagctataattagactctgatgtaaacaatgaaactgaagatcatgttttcaaagaatattgtcctcaagaaatggttactccaaaatgtgaaaaatcaggatataattttacagtattttgtttttaaaattctatatatccacataaaaggactagaaatgaatacacattatcttttgttgtttgggggatgatgggataatgggtactttctattttagcattcttctgcatatttacattttccataataaatgtaatcaaatagtaaagtcgatcattttaaaaaatgaaaacaacctgagaaagttccagttcttgaaaacacactgattctggtgaggcaaaatttgaggctggagtattatgaaaagtcgtttttttcttaaaaattaactctatgcaccatagaaaaaggattattaatgtctatatcccacaatcatatttgtatgtatcagtttatgatagtctataaaccattttaagactatatacacaatgtaacatgttgtatatttttcagattaatattttatttccactcctttcacaccataacattcttcaagtaccaaagtccctagctagtctttttctcttctctaatgtttaagaattatttccagagtttttagctgtacttagtgggaagaataagaaaaaatatgtatgctccatttgtttagaaccagaagtctcttctctcaaatatcgcttcatatattttaatgctacgttattaggtataattggcttagaattgatgtatcttcctgatcaatcaaatctttttttagcagggtccccctttataatctagtagtcactttttgccttaaatgttttattataatatagatatactaactttcttatggctaatatttgccattgtatcttttccatcatctgtcaaccttttaatgtcttttgaatatgacttttggaaacagtatagtgctagattttttaaaaatttgaactgacaatgtttgctttttaatctttttgtcactaattatatacatatttgcatttatttctcatcaattttttatgttttgtatttaccttttcctcatttcttgccttgagattgaattcattttatctccttcaaaggtatacactctattgtctattcttttagtggctaccttattttgacaagcattcttaacagtcatcagttaatcatttatttttactttgaaccttaagaatacaaggaccttagaaaattttaattctgattatcttcttccaatttatatctattgttccttattttaattctaggattaacatttcccaaaagattagccattaatgttttataagtctggaatttttttttttacaattagcaaattacgtggaaagtaatttcatagatctaaacacattgacttttcagactctgttttttttttttgagatgggctggagtgcaatggcgcgatctccgctcactgcaaggtacatcactttaaaacaccctgtaacagagcacagtgaaaagaaaaaatatagttcttcctgttgaagacttccaagaataaaaacaaatgtcattctcatgaaattaacaataatgaatatacagatgaaaaacaagcttttaatttctatttattttattaaaaaacctcatgaactcacataaaataattcattggctcataaaaggagtggaaataaaatattaatcttaaaaataaaccatcctacctagtatgtgtatataggtttgttttttttttttttttttttttgagatggactcctgctctgttgcccaggctggagtgcagagatgcgacctcggctcactgcaacctccgcctcccaggttccagcaattctcctgcctcagcctcctgagtagctgggattataggtgcccgccaccacacccgctgaatttttgtatatttagtagagacagggttttgccatgttggtcaggctggtcttgaagtgacctcaagcaatccacttgccgcagcctcccaaagtgctgggattacaggcatgagccactgcgcccggcatgtatatagttttaaatagtttcaatttacagactaacagtattaaacacccatcataagaagttgttgcaaacaaatattattctggggtatagatatcgatagttatgtttttatggtgcaaagatagagttgacttttaagaaagaaacagaacttttctcggtactaccatctcaaattctgcctcaccacaatctctaactgcaatctgatgtacaggaattatactgttaaacacaattatttattaaagggtgtttttagatttgactacaatgattcaagttatcatcagtgtaatgatttaggcaaaaggaaaatcaagtatgtactttattaagactttgctctatcaggttaatttatatcaagatgttatttaaaatgtgtgccttatgacaatttcccaatgtgttatggtatgttaggagtatactaaagtatgcctaaaaggaaatttttaactaatacatgctcaatttcaacaa

SEQ ID NO: 203 - DNA, 10000 bp, Homo Sapien
atgagtttaacctttttagagttcacacagagtgagtatatgtggattctaaaaaagtatttgcagtatttgcccttatgtacttggtttatttcccttaacataatgccctccgggttcatatgcgctgtcacaactgacaaaatttacccaccttttaaggctgaatgacattctcttgtgtatataggccatattttctttattcattcatctactgatggacatttacggtaattccatatcttggctattgtgaataatgcagtaaagatgggcgtgcaggtatctctttgacatactgatttcatttcgtttggatatatacccagtggtgggattgctggagcatatggtagttcttttttttattttttggggaaccaccatactgttttccgtaatggctgtactaatttgcatttccactgacagtgtctgatggttcccttttctccacatcctcttcaacagctgttatctcttgtctttttgataatagtcatcccaacataatctaattgtggctttaagtatctccctttcaaaggtgaagaaaaacataggctcagagatcaagttattcaaggttgccccagttgggacttgaggtctgtgtttgaaaactcatccttttgcaaaggattccattggatcgaagtggcaagaaccacaggatagtaagcaaccccacaaaacgaggcccattcagcagggacattctggcctttgcattttgttctcttctccatctgaaagaagctttctagtcctcctggagagtctatcagggcacaaccttcctcacctagaacctaggggaggttcccccgttcccctgttctgcgtttagagcttctaatgaataaataccaggcagtattctgctaagctggagttggctttgatctttttttttttttttgcctttcccttttcatggattttaatggttttcatctaacaaactcctcctaccagagagccccagaagaagtggggctagagttgttgacccctcaggattcctcccttccctccctgccaccccaggccctccagttctgaggttccctctggcttagggatttttcagctgcaaatgcaaagctcatagatccgtacagacaaccctaagaggaagagaccccagacacgcctcttcctctctttgggcctcattgcgtatcaggatctgcaaacttgaaaacccacagcagcgtttccttgctgcccatctcagggcctttgcgttgcctgttctgtctggaactctcttcctgaagatagctctctggctctcttcctcactctgttcacctccctgcccaaatgtcaccttgtcatataggacttccctgactcccctttaaaaaatagcatctcccctccatgctctaccccttgccccacataacgtttctttatatcgcttttcatcacctgacacagtcaatattttcttgtttattgtctctctctgctactagaatacagtacccacaagagcagaaacctcatctctcttgttctctgctctagatgcctggcacagggcaggccctcagtgagtattaaatgaatgaatgcctttggcagaggaagctcaataataaaacactttcttcacatccccaactttgttccttttcttccccaaagcccaggccactggaagcccttttcttccttcaaatattcatttctccagggtcatactatgacttttgagggctctaagcattctagtctttgtgggccccttcttccatgaaacaattataagtgataattatgaagtcataaattaaaaattatgttctatgacggcattggtataaagatgcgtatacagtcatgtagcacatcatgacattttggtcagtgtgggactgcatatatgagagtggtctcataaaattataataccatacttttactgtaccttttctatgtttagatacacaaatacttaccattgtgttacaatcacctacagtattcagtagagtaggataccgtacaggtttgtatcctaggagcaataggctgtaccacatagcctaggtgtgtagtaagcttcaccacctaggtttgtgtaagtgcactccatgatgtttgcacaataacaaacttgtgcaaacttctcaaaaaccatgaatgactccctactactaaggagagaaattatttcagtggctaagacttgactagcaggtacctagaatgtcaccattctttcacttacagttttcattctggttcaaataatgacacatttctcagaatgtattcccatcgttaagtgagacatacctgtgttattatatatatccaaactcttcaacctaaaagtttttctttctttcgtatttaaaataaactaaaacatttattattgattcaattttcaaatttaaaaggaaattctcaataatttattgaccatagtaactttctacagtagtcctcattcctgaaaagatgtttaaaaacccaaaaacctatagtataacttaattgatttaaactaggggtgagtgaaaagctgtttttaaatgttctcctggtaattctaatatgcacgaatagttgaggccactgttccagataatatatcccagtttgctccctcagatcattcccttccttctctaagacataatttgaggacatattcattccaaaagctaaccattttaaaaatacccccttgttcctataccatactgctaagtatacgtgaattttagctttttcccttccatatctttctagcccacatattaagatctcaatttttcttaagagattctcccttttcattctgctttaatagtatgtgtagtcctgggtcctgggtgtgcccactctgccttacagatgagtggacccagcattcttctctgaatctcatgaatcctgtggttcctatgccgtgctctttagagctgggctgtccgatgtggtagacacaagtcacatgtgtcttttaaaatttaaatgaattaaaataagataaaatgaaaaactcaactcctcaattgtactagccgcatttcaagtgctcaatagccagccatgcatggctcatggctcccaccctggacagcacagagacagaacacttcatcactgcagaaagttctgctggaaagcgcagctctagagtgaactccagctactccaggcctctgggatgtctctcttcctagaatatggatccttattctgtgctggtgcttgcatccatcacctactagacgagtgaacctgggcacagtcttcaaattatccaagcctcaatttcacagttacagattcagagtaatgaatgtcataggacagatgatgatggtacatcactaactggtactgagtgtgttccagtgctaggtatttgccgtactttacctcattcagccttctcaacaactccaggaggtgagtaccattatcttctccctttggctgaaatcagcaaggttaaataactacccatggccacacagttgataaactgagagctggcatttgaaactaggtctgtctgattccagagcccgctttcttaacttttaattctgtccagtactgcatactctacccaaagaccaagtgagataacacatgcaaatgcttatttgaaaatgtatagattatcatacagatgtaagacagaataatttttgtcatcaataataaaaagaatactaataaataatgggacctcatgtcccagctctctttcatccatgtcctagataaggatttcctttttagtcatttctaactccagactaggacaggcctgacttttacagtcaaatcccctaagatggcctctctgccagctgatacttcagactgccatttactgagccattattggttctaataaggtgttactctgcatctttcctccctgtgctttcacctgtcaaattatctgttttccctgcagtcctgggaagtaggtaggagtagctattattatctccattttacagacaggcaagttgaggcccaggagagattgtgtggcattctcaagtcacaggacccatcaatggctcaagccactggctcctctcctggccacatccagttgttttgttatatgagaatctgacagtggctgcctacaaactaacaaatgactcacatgttcatccaagtttcttggaagtagattaagtctctctaccctcagtgaattccagttgtcttaaaccaatagagctggtgttcaagccctatccacaccagagtgggagacttgaatgcgaaaatcccttttttggtctaatgttagattactcatcccaatgatgtagccctgtcctggttctgcttcttctcaaaaaccatcaatcactccctactactaagaagagaaattatttcagtggctaagacttgactagcagatacctagaatgtcaccattctttcatttacaatttttattctggttcaaagcacagtccctcttaatttatttatctcacctctttaaggtttttcataaacagaatatgtttaggattctttcttgagagccacaagagccagtcttagcactgaacacctggggcagaggggtgggacaattagaggggtttggaatcacccatccattacagtccttccctctatatgcacacacattatttacagatgagaaaaaaggtccacggggcttaggtgacttacttgaccaagaacagacagagaatgagtgactttaggtctcagcctcccagaacccaggtcagggatcagcttattacactgactctcaaacaagcattggcaggtgtataaccctgatccacagagaggaaatcccttcgctgccgttggggggctcgtttagggtctgatagagaccataggcatgcacaggccaaagaaccatgcccgtatgagttggaagggacttcagaatgcttcttatctcccccaaggacaaatatcctcctacagtagaatatgctcctcaggtggccacccagattctgcttggattcccccagtgatgaggagccctccacgttcaaacttttatcaatgagttggacaaagacatgaatgttacaactatcaggtttctgaatgtcggaatcaagatcctgagaagctggagtagagagctgaaacacagggtgaactgaatcacagcctctataaagccctacagcactaagttgcagaaaattagcctgcacaagcatagatcagggatgacggaataatttgtctgaaagtcttttttgttttgttttattttgagatggagtcctgctctgttgccaggctggagtgcagtggcgcgatctcggctcactgcaacctccaactccctggttcaagcgattctcctgcctcagcctcccgagtagctaggattataggcacatgccactgcgcccagctaatttttgtatttttagtagagacggagtttcaccatgttggccaggatggtcttcatctcccgaccttgtgatctgccccgcttggcctcccaaagtcctgagatcacaggcatgagccactgcgcctggcctgaaagtttttattatccacaaactcaacagttaatagtataagccaggtactaaacagttgtattactaggtaatatttgttgaaaactatatcacgtattgtgctcggcacttatgtgcattaactaactttcattcttgaaacgacctgcagaagtagggaaactaaggatcagagaaggcaagccatttgcccaaggtcacacagccagagcctgtgtgttgttagccaccttctcctgccttccacatctttgaaatggggctgggagttacatggaggcagagttggttcatacatatatcctaaaagggtccattcatggccaggtagacacagaactaatgtacccacacaattattcaaaaaattgactactgagtatgcatgtgtgccctcttgtaaatgtgcacattcactcagatgcaggtctctttctgggcctgaggagccaaggagcatgaggccccaccccagacaagtgcctgctcgcagcttcccggaacagtctgtggctaggccagcaagcttagactcgaccagagaccagtggcttcctgctgtgttggggcacaggctggaccttctccagaggcttcagcggaccccaccctcaacccagcccaggctttgattctgccttggcattaaaatctaataacgaatatgtcttgagttttgtctacataccaggcactgtgctgagtacattaacgtgcacgatcttatgtagtctccataaaaccctatgaatatgaatgcagtactcttaagagccctctctcacagatgaaaaagctgaggttcaggaatattgagtaactttctaaggttgaacaggtagcaagtggtagagctgtgatttgaaatcaaacagtcagattcataagtgaccacagctctttccagaagcacagtcaggaggaaagaacctggctctaattctcaccctgtgactttgggcaagtctctttctttctttgggactttattttccagcttccaaaaggaaggaatgatcatgaaaggctctttcagcgttcattctgtcattgtgtttcctaagtctagattcttccatttctcaactagtattgattgagcctggttctataccaggcactgttctaggcactagggaattcatctgtgaataagatacacagagctcctctcttcatggagtccatgaagacagtcattaaacaaataaacaagaaaatattgggtagtgatatatgtcatgaagaaaatagggcaaagtgataaagaggggaattgacaggaagtctactccaaacaggagctcaggaggtgacatttaagctgaaaactgaatgacaagaaggaactattcatgtgagaatcttaagggaagcagtaagtgcaaaggccccgaggcaggtctgggttttgtgtggctgcagcttgtgaactggagaagtagcatgggcccaggaggtgcagagccttctaggccagggcaaggagtttctattttaatctaagtgctatgggaagccactggaaagtgttaagcagggaagtcatatgaattgatgtacgtttacacaagatgttttaaaatagtggtccctgggtgttgtgaactaggaaggtagtacaaggagcctaacatgcttctgcgccctgcaagcttgttcactcatctaaacctggggccaggaaacagctgtgcagacactgttccctccctcagcaaactactccccaggtgtgcaggtcctacagcctgggcaggtcatgggcaccaagccaccatccaagggtgcattctctctgcattttatcctcctccagggagatccctccccttccccttccctacagctcatcttaacggcgcctgcattgcaaggcaccggtgcagccatcgagcagagtatcttgctggggcctgcccaacacgggtgctgacctggtgaacaggaagctctccacacagcagggcaggcagggctgggaggctgcgtgcaccctgggctcacagagctgtggagccagtggacctgggactggggtgaggactcactttcccttggggtttcaacttcaaaagcaatgccatcctgcatgggttgggggctgaatgactcaggcgtccccttctgcttgtgggggctgggtcaggggtagggtgagtgtggcttttgcctggggctggccccactatgggctgcagctctaagcatggaaggacagtagtgggcaggcagggcgggaaacgtacagcagctctttctgccactaactttcagacctcgaatgaagaatctgccaccttcctgccctctcttttctgaggtgcctaagcttagggcaccaccaacagaatctcaggagttgggaggcgggtggtagggaagctcgaagggtgggacatattgaaattattttctgtcacaggccttcagaccccgatttaggcagacttttctattcctgcctcttatctcggaatgctgtcagcatgatcttggggaaccctgtgcccagttcacacaggactctggcaagacggggctccaagcctctccttccccctttgccttggaagtttaactcttccttggctttgaagagcaaggcaactggaaaatcaggtctggccagtttcatccaagaatgctccagcgcatctggctggcagccatgaagctcctaggaatcaaggctcccaggggcaagccaggcatcagcctggtgcaccagacctacacatggccctgccaaaccctgccccgctcctcctgccccttgccccatccttggccctggtgagtctcacattttcacccaggctggagttcggggatgggctctgtgggaaacagcaagggtctaagagaggcgaagcatttattcatgatcagttcaacaagaactaactcccagggactagttcttacccggccacacactgtgtgacttggagcttgactgatctcgactctggggctctatttccccatctatactcatctatgatgaaaagcagggacagaagcccatcatctctaatgtccatttcaactcagacattccaggagcctgggagttttcatgttccaggttacatgatgagtcagagtcatgccctgtctataagggacatgtggtgaaacaggtataaataggactggggcaaggaggcaaccctggtctgtgcaaggagctcccactagctataaggccctgggcagctcccttccttttatgaaccttagtttcctattatcaataatggctgacattaaattagaactgacaataaactaggcactctgataagtcatttacctttattatttcactgaattttcacaacaatcctaagagattgatgattttcttatccttattctacagaaggtgaaatgaaggctcatgaggttaaataacttgctctaaaagtcacctacctagcaaatgacagaggcagggctgacagccaggcagcctgatgccacgcctgggatcttggtcactttgctttcctgcagcctctgcatgtgcggaaacagctcagtttggctagagctcagccccagtggaaaggccttgtaggaaggagagagaatagtagtttagaaccagatagctaaacttggttcctggctaagagttgggactatctcaccatcgcccaaggagtcacagaaagtttttgggaaaaaagagtaagagttcaggactgtgttctagctgctgagtgtctttgagagagcattttgaactagtctgctattcttcagccacggggtttctcaaccatggcactattgacattggggctggataattctgttgcagggctgatatggtttggctgtgttcccacccaaatctcatcttgaattgtggctcccataatcccccagtatcatgggagggatccagtgggaggtaattgaatcatgggggtgtgtttttcccatgctgttctcgtgatagtgaataagtctcatgagatctgatggttttacaaaggggagttcccctgcctacgcgctcttgcctgctgccaagtaagatatgactttgcttttcctttgccttctgccatgattatggggcctccccagtcatgtggaacggtgagtccattaaacctcattcctttataaattacccagtctcaggtatgtctttattctcagtgtgagaactgactcacacaaaggcactgtcctatgcattgtaggttgtttagcagtatccccagcctctacctgccagatgccattagcaccaccacccccaagctgggtcagccaaaagtatcttcagacattgccaagtgtcccttgagggtcaaaatcacctccagttaagaatcacagcagtagaaaccattttttccccctaacttgcgccctgtcttttattttctgcccagggtttc

SEQ ID NO: 204 - DNA, 10000 bp, Homo Sapien
aattttgttagagaacctaaagcacctagagttatttctaatattagaagaatggaatgttagtcttatgattcccctaaaagcccttttaaagatatacaataggtgatattatatatatgtcacctatgtacacatatgtacatacacatgtatgattccttaatagcctctttaaaaggtctcaggttgtcaaaggagcacatgaaaaggtgttacactatggtttcataatccacatgaagtttgtcccttcaatgatatttgtcccctgacatttctgtagcatgattgaaatatctatgttaggttaccagggcatggagtcagcagtatgaattatctgtactttgtatgggtacagatcttaccttgctacttaatcagtcaggatggaccaagtgttgccacagaaaaagaaaaactctttttttttttgacagggtattgctcttttgcccaggctggagcgcagtggcatgatcactgctcattgaggcctctcctgcctgggctcaaatgattctcccacctctacttcctatctggggccagagtcgcttgccacacccccagctatatttttttttattttgtagagacggtgtctcattatgttgcccagtctgatctcaaaccgctgagctcaagcagtcctcccgcttggcctgccaaagtgctgggattacaggtttgaaccaccacaatcaggcccggagaacagctgtcaaatatcaatgaactaacagcaaagctttgtttttacaatcactttacatgagcacgtggattggcaggggacctctgcccaatatctttacacagaaacccacagaagactcactcttgacacatgtttgcaaatcaccactgaacggaaaatgaaagattgtcacttgctctttgaaattttcttttaagtgaccttgtcacttctaccctcaactcattggctgaagcaagttacagcgtgggcggctaacttcaaaaggtcagggacagcaatcctatcatgtttccaaaaagagaaaacaatgcgaatcatctaatgccaatcagaactaccataaatgattagactgatcccaggagggaaagggttagtgtaaattcattactgttgtttaaaaagatgctcgacagcacatttgctgctaattaatggtgtcatgtttgaagaaagaatccgcaaatgcttatttttaataattgaaaaataaggagagctttttctttgatcgtgaattagtctgtgcagttggatgataaattacaagtgattacaactaccacttatgctgctaaattatagctcttcagcattgttagaaacaaaaaggaaagctggtctccatggaggtcatatacatattttcttaggaggagtgagaacaggtgttgaaatttaaatggtaagaaccttaagttcatagggaagacagctgaatagaaactgaggggcaagcttggggagccctgtgggatttttgcagggggcatggaggaggaagggagtagaagaatgctggcatttgtttattcatggtaagaggtgctttggtcaagaagggatgaaaatgttttcatgtttataaaacagtcattgatcaacattctttgtctctccctctccatccctctcttcttcccttccaccttccacttctttctttcaccagtatgacaaaaacttggtagcctaccattctggattctgtctatagaactggaaattcctctatatacagaacttacattctagtagttataacagtgataggtgtatgtagaaaacctaaagcagagtaagaaatacagagccctgaaaagcactactttttagaagtgttcatggaaggtgtctttgaagacataacattagaggagagagaataaagtgaggaaacaagccttgaaatgacatagaaaatagctttccaaatggagcaaatattaagtgccaaggccctgaggtagaactgtgtttgtctgctattagtgctgggccttcagagatgagtgcttgcaggacttggtataggacctggcccacaggagtggctcattgaatatttgtgggatgaatgaatgagcagatgaatgaatgtaaaccccatccccaaagaattcccactgtagcagaggatggaagtctgactaaagataactacttggtagcaataacaacattcagcattgctcttcattgggtagggcactaagatctttacataagttatcttacataattcacaaagcaatactatggacacatgttattgctcccattttgtaaacagaaagtcaacagagattctgttataatgtttaagtgtttggactccggagccagactgccttgatttgagtaacagtacttccacttgccatctttatgaccttaaacaagttacttaacttctctgtgcctgggtttcctcactggttttaaaaaacccgaatataaccgtttcaggacattggtgtgaggattgtgtgaattaacatatgcaaaatacttaagacagtaactggcactatataacttttcttataataaatgctgtcatcatcattttcaagattatgtaggaaaatagggatgctaactgcttgagaattccacagaggtcttcataaataagatgtttgaactaagatttgaatggaaaggtaggaattctaaaatgtattcaagtggtatgggtgtgtgtaaatatttcagctaattcagcattgattttttcagggggatttaaaaagtatatttggtagtaaattgtctcctttttgctgaatatcaggctactataatataaattccaccttgttcccccaaatgcttctagacttacaacttgtatacatgagaataaaatcattgtcattttccatcttataagacaaaacataaatctagcctggtttagcctccattgtcattaaataaaaaataagaaaatgatctcctgtgcagatagtcaaattgaaaagctcatgggtgatagttaaagtttaatacccactgaggccattttaggaatagcaataatttggctgtgtataattgtgtgtttatgtatgtgtacctttatatgcatttctacaacacaagctgttactgaatcagagatgtgtgaccttctttcatagatataaaaattacacctggaaatattctctgagtttacatgagagaagggaatggcttattttacacatataaaattatacatatcttcacagcatcttaatccatttttttctttagccgtgtctaaatggtttaagaacgcattacctaataagtttggtgtggggaaaaatgccttagaaaggagtaaagcaaaatctatcaccatctctcttttaataataaatatgcaagtggatgattacaaaagaagagatctggagatgactgaaaaagaacattgtgagggtgttggattatcgaaatttttatacattagaattcagtgtttattttgagaatgaaacacattttttctatttacatttacacaaataaagtgcctctgcccacaaacagtccttctatgagttaggaataattttcctgtggtataaattggtacttctgtttctggccttagttctgggctcacacagatggcctttataaacataatctattatttacataaatcagttctctctttaccccttgtaaacactcctgtgcagttatttgaattcagatctgattatggatggcaaatgtatagcaagaaaaatggaaaagctaattattttactatttggatttatttttgtaaaataatttccaaggatttctttagagtttctctgcaagggtaacaaattcctcctttctttcagttccctccttcatctgaatctcaggtcttacaagtgattaacatctcataattcactatggcttcagcacttgtacatttcaagggccattttagcaatagcactaattcatgtttacatactttgtaatgtaaatgaactgtgatacttatgtcgttaactgttatttaacaacgtaattttgtaaaaatttgaaaggcatgtattttctaatgaggtaaatacagtatctgttataacaatgactaggtctaaatgtttttaaacattgcattggaggccctgagcagaaagatgcaatatatttgagtatgactttgttttgtaacaaaaacgttgctctaaggcacagatatttgttttggtgaagttgaagtcactataaacatgtgtggcttccttattcccaccatctgtggttcatacactatcctcaactatgagatcacagttgggcaagatggaatttccttgtttaaattttctcatcggtttttcccacagaaagttactaatgactagcatattttgaagtctactttcattatagttcatctatcttcatatatatatatatatatatatatatatatatatatatataaatgtgtgtatttggcatttatatatatgtatttggcatatatatatgtatttggcatttacataaaaacaagatcagtgatgggtaattttaaatgcatattaaatataaacaccaatgcatagaaatattattttatgaggtaatgtcttgatattttgttcgtgttaagtgctatgaatacatatgataaagatattatttctagaaacaaacaaaaaaagattgggacccaagtttattgattgataacggttagcccaatgcctacacataattaatatcaataaatatcaaagaaaggaaggagagagggagggagtggaagaaggagagaagaaggggaggaaggaaggaagaagatagcatagcagtcagaatgttcagatactatggtggcttcactaactttgtagtcactttaccttgggcaagttatttaacctctcaaagtctcagtttcctcatctctaaaatggaattgttttgattaaatgagatgaagcagttagtgcagcagcaattaatacattttagaaatactttcaaattatttttaatgaatatgaaattttaattaaatgagtagtatcagctgataattttacctatgaatacagattactcattttcaaaaattagtggtgaacacacttcaatactacagtttacaccgaacataacttatgtttttcattgaccttaaaggtacatatatataaattgttaaacatatgtttatcaggtgagcatctattatgttgattcgcactggtctaaattctggggttacatagttaagtcttctcagactagtagacaagcagtgtactgtagtgtgatgaatgctttaatctaggtacacagtgggatgctgtagaagtaaaggaggagcggccgggcgcagtggctcacacctgtaatcccagcacttcgggaggctgtggcgggtggatcacaaggtcaggggtttgagaccagcctggccaacatagtgaaaccccgtctctactaaaaatacaaaaaaattacccgggtgtggtggcaggtgcctgtaatcccagctactcaggaggctgagacacgagaatcacttgaacccaggaggcagaggttgcagtgagccaagatcacaccactgcactaaagcctgggccacagtgcgagactccatctcaaaaaaaaaataataataaaatttaaaaaaaaggcaagaaggagcatctgtttaaatttcaaatagagaggaagtgaaggattggcaggagaagttaatgagtggatatctaaggtttcctgtcagtggtgaaatttgagttagatttctgtgataggcagaatttctaggaatgacccccaagattccacgtgtcctgatcctatgaatatgatgtgatctcgctcccctgattgtattctgttatatggaccagctgaccttaaaataggaagattatctggttgggccttataagcagagaactttaccagctcctggcagaaaaggaaggcagaagaggagggcagaagaggaagtcagagagatttgtagtacaagaaggatttgatgtgctgttgcttggttgaagattcagggaacaatacaagaagaaatataaacaaccttacagagtttggagaggccactggctgacaatcttccaggacacaaggaccacagtcctatagccacaaggaaccaaattctgtcaacagcctgaaagagcttagaagtggattattcatcagagagccttcagataagaacccagccaaacccacctgatttctgacctaaagaaactaagagattataagtgagtgttgttttaagccactaggtttccatgaatttgttacaaaggaataaaaagataatataattttgaagggtgtgttttaaacagccaggaaaagaaacaaagaccaaaaggctacttaaaaagcagatggaaaaatctaacagagaattcacagtcacgagggtgtaaaaaatgcacaaaatcatagtataggacaccagtattagtgacagcaattaccattataccaagagtatggagctataaataaacatctagtatctggatcaacagcattttattcattgtttgccatggttgagtgataaagtagctaacattaaaaggtaagaatactttttcacttatatctatctaaggatcttgtgtttgtatgtatagggaagtttatttttggagatgtgggaataatatacattgaataaaacattattaaaagtaggcataaattaaaatatataagcaatttcaatttggagaagagggaatgaggtgtactaaaatttataaagaattaaataaagaggataaagacaaattggaaattgaaaaggaataagaaacatttttctgtgttgggattgtagtatgtagaaatctaatcttatagtataatatttgtaattaagatgcttagttccaatatgtttcattcagcactgggttattgtttagtacatttgtgcaataattagataaaatatattttaatgaaagtagattttgtgagttggaaaatacacttgctttagcaaagtaaactaaagttaatgtattttcaccaaatatagttttcttttaatttttttaaattttgtaaaaatgtaagacatatttagagtaactccctagttagttctttactaattgatgctttgaaaagacaatgacttttttatctgatgtatttttaataaaatagtctctcacatcacatttctaatgaatgcattaaaattctcaagtgactaaagggagtttaaattatctctgtattattatgtcagccatctagatctatgatatcaaaatatatatatttaagatgtgcacaaattaattaaaatgataagtttctaaatctctctttgtataagttccaagaattataaaaatagcactattttctgatcaaacagttaacactaaattttacaatgtttgtaaatgtggcttagaggccagtctttttacatggttccttggtttacaacagcagccaccatgataatttcagcaagtcaatacaatgtgttctaaaaaaaaaaaaaaaaagattggcaaactttttttttcctaaccatgttctgcattatttaactttaaagtagagctcatctttctaaagaggaaaatagtgagcagtaaataaatctcttttgataagataacaatgaaaggtagttatctagtccaaccagcagtgcctcaacaaaggctaagcatcagaggcagaaaataataaaagaggagcatttttcttcccctttatatttttgtttcatatttttcttttctttctttttttttttttttttgagagggagtttcactcgtcgcccaggctggagtacaatggcaccatcttggctcactgtaacttctgtatcccgggttcaagcaattctcctgccttggcctcccgagtagctgagattacaggtgcccaccaccacgcctggctaatttttttgtatttgtattagacacggggtttcaccactttggccaggctgttcttgaacttctggcctcacgtgatccgcgcccccccccgaccccagcctcccaaagtgttgggattacaggcatgagccaccgcgcccagcctgtttcatatttttctatggaaaaattggattgtagtggagaaagagaggaactgttcctcccaccttcacttgtctactctaagaccaaagttacttcaaaataagggttttgttgaggaaagcagtctgcctcattttctttttccacagacctaaatataaaacttgatttccaagtagaacattaatcaatgttgtctctgctcatcttggtggtttaattggttcaaacactctggcattaactgtctagggattttctaatttgcctatggtcagaaatgcttaattgatttctgttctgatcttttcatagaagttctgaccctttctttagcaaaaccgccttacttcatttctttaataaggttgagaagtttgcttagtctatttgtttcataaataactctcgcccaaagtttaagtaatggatttagaggtaacactgagaaattcagagaaggaagtctcatggctttatggttctagatataagaattatagcacaggggtagtttatatttctttatattagggtggccaccataagtatgagtacttcatgagaagaggccctgacggtaggaattacggtattcctgcccacaacaccccctctaagttttctgaattctgcagttttttccaggtgtatggaaatataattgataaacaaaaaatgtatatatgtaaggtatacatatgtatacattctacttgtatacattataaaagtacatatgtatacaatgtgaaatgattaccataatcaaactaaataacatatccatcactgtaatttgttactcagtgtgtttgtgtgtggcggggggtggtgcgggggagggtaagggcacttaaaatctactcacttcacaaaatacaagtaaacaatagaggaatattaactgtaatcaccacgctgtatattatagccccagaacttactcattttatacctggaagtttgtacccattgatctacatatcctcacttcccccaccctctgtagctcctggaaatcacctaaattctgattgtggattgtgtttcaagcaatctaggaaaagagagaacatttttatagttataaaaaagttcaaaattattattttaatatcacaagcaatatgtgccaggcaaaaagaaccaagaaaaagatataaaccccatgaagacagaaatttttgtctgctgacttaagttaatgtctgtatttgagcccacatgtatacttcatataagtagaggccatatgtgttcttgtttacaaagtgctttgcactatgcctagtgcatacatacacacatacacgagtgaatatctatataaatgtattctctataggattctactatccattaaaaaatttgtccttttacttagtatatcataaatatcttaccacataagatgtatatttctacagacataaatttaatggctgtataagatataatttactaatttcttctttttattcttttggcctatttccatttttaaatttattattataaaaacaattcttcgagaaagacatcaccattttattctgcacatataattattttctaatgataaagccttaaaagtagacttgacagataaaagtatgttggctcacaaatataatgcaaatactgtgctgaagaataaattgaagcagtcactcattcttagctctggattaaatatagttcatttcattgttttactttgaatacattgctgaaatgactggctctaagggaaagtgtgctttgattaggagcaggtttttataattctcttctacatgcccatcctgtaaatggtatctttgtgtaaaaaagaagcaagcataaggacacatagaccagaatagagaggaac

SEQ ID NO: 205 - DNA, 10000 bp, Homo Sapien
  misc_feature 4546, 4547, 4548, 4549, 4550, 4551, 4552, 4553, 4554, 4555,4556, 4557, 4558, 4559, 4560, 4561, 4562, 4563, 4564, 4565,5066, 5067, 5068, 5069, 5070, 5071, 5072, 5073, 5074, 5075,5076, 5077, 5078, 5079, 5080, 5081, 5082, 5083, 5084: n = A,T,C or G
  misc_feature 5085, 5086, 5087, 5088, 5089, 5090, 5091, 5092, 5093, 5094,5095, 5096, 5097, 5098, 5099, 5100, 5101, 5102, 5103, 5104,5105, 5106, 5107, 5108, 5109, 5110, 5111, 5112, 5113, 5114,5115, 5116, 5117, 5118, 5119, 5120, 5121, 5122, 5123: n = A,T,C or G
  misc_feature 5124, 5125, 5126, 5127, 5128, 5129, 5130, 5131, 5132, 5133,5134, 5135, 5136, 5137, 5138, 5139, 5140, 5141, 5142, 5143,5144, 5145, 5146, 5147, 5148, 5149, 5150, 5151, 5152, 5153,5154, 5155, 5156, 5157, 5158, 5159, 5160, 5161, 5162: n = A,T,C or G
  misc_feature 5163, 5164, 5165, 5166, 5167, 5168, 5169, 5170, 5171, 5172,5173, 5174, 5175, 5176, 5177, 5178, 5179, 5180, 5181, 5182,5183, 5184, 5185, 5186, 5187, 5188, 5189, 5190, 5191, 5192,5193, 5194, 5195, 5196, 5197, 5198: n = A,T,C or G
tgagaaccagcttgggggttcttcccttctcgtgctcattatgtcagagggacagatttctaatcgcttgaccatggcttgacaaatgcccagcatacctggaggccctctttcctgccttcatgtctacctactctaacattacaaagcatccccaatatattggcttttctactcccgaaaacaccaaagctccccacagctcccacactagtgataccccctcttctctgagaaacagcagaaccaaacaggggtcttgtacattccaatcaccaattgccccaagttacctctgttcacctattatctgtctttctccttctcaagtcctgtcagggagcccctccagatatactctgaacccaggcctcctactattcaacaacttcattccagtaattgtcccctttcgcttttctaccatttatatatatatatatgtgtgtgtgtgtatacacacacatatctatatctatatctatatctatatatatatatcctttttttttttttggctggataagtctcatcaccatgcaaacatctagcatccaaaaaaaaaaaaaaaaataggccagggagtttggctcaggccaactttatatctgtaagctctgcctcaatatctgtgtggagaagagtgacgacagactgacacaggcagccaaggtgttggagcaactcacaggccagacccctgtgttttccaaaactagatgcactgtcagatcttttgttttcaggagaaatgaaaagattactgttgactgcacagttccaggggccaaggcagaagaaatcctggagaaaggtccaaaggtatgggagtatgaattattttttcttaacttctcagatactggaaactttggtttccaggaacacaagaatctgggtatcaaatatgaaatctttggctgcgactttctttcttcttcttttttttttttgagacagggtctcactctgtcatccaggctcaagtgcagtggtgtgatcacagctcactgcagccttgaacttgtgggctcaagcaatcctcctgcctcagcctctggagcagctggaaccacaggtgcacaccaccacacccgggtaatttttttttctcttgtagagatggggtcttattatgttgccaaggctggtgttgaactcctgggctcaagcgatcctcccacctcggcctcccaaagtgctgggattataggcttgagccactgtgccaaacccatggttttatttttattttatttttgagatggagtcgctctgtcacccaagctggagtgcggtcgcacagtctcagctcactgcaacctccgccctccgggttcaagcaattctcctgcctcagcctcccgagtagctgggattacaggcgcgtgccactgtgcctagctaatttttatattttcagtaggggtttcaccatgttggccagggtgatcttgaactcctgacctcaggtgatccacccgcctcagcctctcaaagtgctggaattacaggcgtgagccactgtgcccggcccagcccgtggttttaaatacgactcccacatttgtatttctcaccttgacgtccctatcaagcttgagactaacacattcttggcaatctaataggcttctcaaagtaagcatgcctaaaatagtacttttttttttttttagacagagttttgctctgttgcccaggctggagtgctgtggcatgatctcggctcactgcaacctctgcctcccgggttcaagcgattctcctccctcagcctcctgagtagctgggattacaggcacacgccaccatgcccagctaattttttttttttgtatttttagtagagacgggggtttcatcatgttggccaagctgatctcgaactcctgacctcaggtgatcccccgaccttggcctcccaaagtgcagggattacaggcgggagcaaccacgcctggcctaaaatagtattcttaattcagtgcccacccaatcaaaaaagttgtaacttccccatctcagtcaatagcactatcatttagcacccagttacttgggtcaaaaacctagaaatcattcctggtttctctcttttttcttcctcacctccccagatcttccacctcttcctattgccaaccaaatccatggagaggcccacctttattacacacacaccccatcactctcatgctggttcaagtcaccatcctttctggcttgggtgataacaacctcctaactattctctctgcttcttctgttcctgcctcctagagtccattcccccaacagtcaaagtcagagcatatcattcctctgttcaaaaccctcctttggtttttcggtgtatttacaataaaatcaaaactccttatcatggctggcaaggtcctatcttcaggggttatcaacaatggctgcacattagaaacatctgaaggacttaaaaagaaaataggagaccgggcgcggtggctcacgcctgtaatcccagcactttgggaggctgaggcgggcggatcacgaggtcaggagatcaagaccatcctggctaacacggtgaaaccctgtctctaccaaaaatacaaaaaaaaattacctgggcgtggtggtgggtgcctgtagtcccagctactcaggaggctggggcaggagagtggcatgaacccaggaggcggagcttgcagtgagctgagattgtgccactgcactctagcctgggcgacagagcgagattccgtctcaaaaaaaaaaaaccaaaaaacaaaaaactcccaggccttgccctaacaaattcagatttcattgatctgggttgaggctggagcatccatgtcgcttttaactccccaggtggttctgaggggttcagaagcccttccctaagagttctggtccttccccaccaatggatgctcctctgtaactgctcttccacttccatcactaaagctctgacctcggctgggcgcggcagctcatgcctgtcatcccagcactttgggaggccgaggcgggtggatcacctgaggtctggggttcaagaccagcctggccaacatggtgaaatcccatctgtactaaaaatacaaaaaaaaaaaaaaaaaaaaaaaattagccgggcgtggtggcgggtgcatgtaatcccagctacttgggagaatgaagcagaagaatctcttgaaccccgggagtggaggttgcagtgaagcaagattgggccattgcactccagcctgggcaacaagagggaaactccatctcaaaaaaaaaaaaagaaaagaaaacaaagacatcatctcctcacacgtgaaaattccaagtatccagagcaagagccatccccaaatgtaatgtaaaaccatggcataattctacatgccacataaaacctgcattccacccccatcccactcaacaagccctacagacaatacaagggctgatgccctggggtatggggagaaaactgtcctagttgacattcttctaaatgctgagcatagctgactggggcatttgttcatttttgggacttgatgatcaccttaccttcccactgaatggatgatgccaaaaaaagaaagcagaaaagatatccagccttgcttgttcccctgataggtcggcagataacttctctctacttctgtgaagtaatgtgggcactggcaacattgagggtgggtaatctgacccccacccctactgtggcctatggaggggtgagacctgtggatgatcgagctttcactttgagtcagcatgtctcactttgaattccttcaccattgcttattagccatgtgaccttggccaagttatttttgtatttttgtgagtctttttttttgagacagactctgtcacccaggctggagtgtggtggcgctgtctcagctcactgcaacctccgcctcctgggttgaagcgattctaatagagacagggtttcaccatgttatccagaccggccttgaactcctgacctcaagtgatccacctgcctcggcctcccaaagtgctgggattacaggcgtgagccacggcacccagccagccactgcgcctggccttttgtgagtctttaagatggaaataacagtcatttcttacgtataacatgggctgttcccaattgcattaatatacatagacattttgttttgttttgttttgtttcgtttgtttgttttgagatggagtctcactcttgttgcccaggctggagtgcaatggcatgatctccgttcactgcaacctccacctcccaggttcaagtgattctcctgccttagcctcccgagtagctgggattacaggcatgcgccaccacacccagctaatttttatatttttagtagagacagggtttcaccatgttggccagaatggtctctaactcctcacctcaggtgatccaccggcctcggcttcccaaagtgttgggattacagatgtgagccaccgtgcctggcccttacatagaaatttttactttctgaaaataatattttaaaatgctgttgggggctgnnnnnnnnnnnnnnnnnnnntgggaggctgaggcgggccaggtggggcgaggtggatcacgaggtcaggagatcgagaccatcctggctaacacggtgaaaccccgtttcttctaaaaatacaaataattagccgggcatggtggcgggcgcctgtagtcccagctactggggaggctgaggcaggagaatggcatgaacccgggaggcagagcttgcagtgagccgagatcatgccactgcactccagcctgggcgacagagtgagacttcgtctcaaaataaataaataaataaaacaaaataaaataaaatgctgttggaggccaggcactgtggctgatgcctgtaatgctagcactttgggcagatcatcttaggtcaggagtttgagaccagcctggccaacaaggtgaaaccctgtctctactaaagataaaaaaattagccgggtgtggtggcatatgcctgtagtcccagatactcaggaggctgaggcagagaatcgcttgaacccgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggaaggcggaggttgcagtgagctgagatggtgccgctgcactccagccccgggcacagagcaagactgtgtctcaaaaaacaacaacaatacaacacacaaaaaaaagacaatacataagtgaatgaacatagctgtgttccaataaaaatttatagactctgaattttttttttttttttttttttttggagacagcgtttcattctgttgcccaggctggagtgcagtggtgtgatcttagctcacttcaacctctgcctcctgggttcaagcaattctcgtgcttcagcttcccgagtagctgggactatgggcacacatcaccatgcccagctattttttttttttttttttgagatgaaatgttctgtcgcccgggctggagtgcaatggagcgaccttggctcacttcaacctctgcctcctgggttcaagcaattctcgtgcttcagcttcccgagtagctgggactatgggcacacatcaccatgcccagctattttttttttttttttgagatgaaatgttctgtcacccaggctggagtgcaatggagcgaccttggctcactgcaacctctgcctccctggttcaagcgattctcctgcctcagcctcccgagtagctgggattacaggcacccgccaatatgcgcgtctaatttttgtatttttagtagagacggggtttcaccatgttagtcaggctggtctggcactgttaacctcaggtgatctgcgcacctcgtcctcccaaagtgctgggattacatgtgtgagccaccacgcccggcttcccagctaatttttgtactttttgtagagacagggcttttgccatgttggccaggctgatcttgaactcctggcctcaagtgatccaaccgcctcggtttcccaaagtgctaggattataggcgtgagccactgtgcccagccaactttcatattctctagattattttcaacagctgggcagggtagctcacgcctttaatctcagcactgagtctgaggcagatggatcacctgatctcaggagttcaagatcagcctgaccaatatggtgaaacccccatctctactaaaaatacaaaattagccagacgtagtggcacatgcctgtaattccagctacttgggtaggctgaggcaggagaattgtttgaacctgggaggcagaggttgtagtgagctgagattgcgccactgcattccagcctgggcaacaagagcgaaactctgtctcaaacaaacaaataaaaacataaaagcattcttagctcatggccgtataacaacaggtgttgagctggatttggcccttgggctatactttgctgaaccccactgtagtggacactgtggtagcctcctgacagcccctcctgccttcccattatgtcgcaactgtttgaatttggaaggaactgacccatccctagctccaggaggagcataactcttaacctaatcagttaattctttttttgaaatagggtctggctctgttgcccagactggagtgcaatagtccgatgatagctcactgcagattcaaccttctgggttcaagcaatcctcccgcatcagcctctacagtagctgggactccaggtgtgcaacaccatgtctggctaatttttttttttttttttttttttttttttgagacggagtctcgctctgttgccaggctggagtgcagtggcacaatctcggctcactgcaacctccgcctcccgggttcaagtgattctcctgcctcggcctccagattagctgggattacaggtgcgcgccaccacaccgggctaatgtttttgtatttttagtaaaggcggggtttccccatgttggccaggatggtctcgatctcctgacctcgtgatccgcccacctcggcctcccaaagtgttgagattacaggcgtgagccaccgcgccctgctgataatttacatttttaaaggatcattctggttctctattgaaaatagactgtagagagaggtgagggtagaagaagtgagaccattcgggaagcaacttcatttatccaggccaaaaatgatggtggtttggaccagggcagaaacaatggtaaggatgagaagtggtcagattctggatgtattttcgagcagaaccaacaagatttcctaaaggattggccatggattatgacagaaagaggagtcaagtacaactccagggtttttggccttggccactgggaagatggagttgccacttactgagacagaagtcaccgtaggaagaaacaaggttttgcgggggaggtggtgcgataggggtggggcaaggaaccaaatcacaggaaggataaaggtggggctatcttcaggctggcacaggaattcaaacgctctcagaactcatgcctcttcatcttttgtctctggttctcttccttatcagcctcattctttccttctacagacagcgatctcctggacatgaaagatggacaagctgatacccagcttgagctctcaagagaacagaaaggcgtctcacactctccacaaagctagaaacaaacaacactgtggaggatttttactggtcatacattgggtcatgtgcccttccctgagccaatctgcagtcagaaggatgaagtactctaattggccagttttgggtcacgtgcctgttcctggctgtcattgcaccaacacatcagggaatggggagttgaggagtgaggagcttcccctacacagagagacggtgggtagcccatttgtccgctaaaaccttcaagatacatctagaatgcatccatccacatcgtgctaggctgagctactatcacctggtacttggaaccgcctcctcactggtctaccgtctcccttgcaaacattttctacaacagccagtaatccctaaacatgaatcccatcacatcactctcttcctgtgctcagcttcccattctcaagggaagtcctcccatcttctaaagaatatctacctacccagcccaattatatatgagctttttaggtttttttttttagagcaaaggaatgacaggttttgtcaagctgcaggtgactataagatacagacagctgacaattgtggactcctcaggcgtggtgaaagattgagctactatcattagggttggctggctaggaccccggcaggcacctggggatagtagtgctgggaagttctggggagttgcacttctgaatgctggcatgacactgcctcaagacatctctctatccaaatggaaaaaacaaccacatcctttgtcagctaaggagagttagcaaactgtttttattaaatactgatgtctggccgggcacggtggctcacgcctgtcatgctagcactttgggaggccgaggcgggtggatcacttgaggccagtagttcaagaccagcctggccaacatggtgaaaccccatctctactaaaaatacaaaattagccgggcgtggtggcgggcgcttgtaatcccagctacccgggagactgagttaggagaatcgcgtgaacccaggaggcggaggttgcagtgagccgagatcgcgccactgcactccagcctgggtgacggagtgggactctgtctctaaatacataaataaataaataaataaataaataaataaataaataaaaatactgatgtctccaagctttggctatgtgttgcaatgtacaacctttccaatgtcgctgcaccattgcatttagaggaaatctccattccctaacaggaactacaaggccccctgcatgacgtggcccctgctgcctgttcagctccttggctcgaaatccttccccttatcttgctgattttgttttagtcccaatgtctcctgccccctcacctcagtttcttgaatacgtcaagacttctttgtctctgagaggtagctcaagttttcttctctctgcctggggggtggctgcgtctttttggttctttttagttaaaagtctcaccaaagaggtattttcctgaccccttacctaaactagtgcctgctcagttatattctcaatcataacactttatttcctgtatagcacatatcaaaatttgtgatcatttcatttgttgaatattttacctcgtggcaaaatcacacgccatcctccaaggggcgagacccctcagtgtgaaaggggcaagagacacagaacaagagtgacaaacgcataggaaagcccagaggccgctgccttgaccacagtgggtcggtctgagcagttcagtggttaggtctcttaaccaagaaagatagagcaaaccattcatgctcatgctggacttctggtttccttctttttagtcaactaggttcaaccctgatggtccaagaaggatatgccattttcatcctaagaacctctctaggaaccccaagtgggctccccacttggtatttttgctaagcaatcactgttggggggggtacaattacaggcagaaaggatctgagccccacccctcgggactcaggaatttgaggaccttggtctttaagatctgccccatcagctttcagaaagggcggggcgacgggagcagctgtcacctccttctctccaccctgccggcgttcacgtgtgttccgctgtgcagtaacagctcttcttccgggacttcctggtcgccgcgaccaatcaaaatgcttttcctgtccttaccattgtcagccgctgccaatcggctcgcctctaccaacgccccttaaaggcgcagccactgcctccggagccggggcgaaccaattcc

SEQ ID NO: 206 - DNA, 10000 bp, Homo Sapien
agctctctcgtgtatcacttagaaagctcatccgtggatgtctgcagggcttcaggcaggactgagtaactctgtagcactgagtatctttgagcagtctggacacagtccacaggtaatgacggttgttctaagggggacggaaacgaaggaaaagagaatggactatctgcatgggagaaggggatgaacgtagtgggccacagggacgtctgagatgggctggggtagagggagggatgaatcagccatcaaggtgccctccctccctcaggtcctgggcaggaagtgtaccaggctcactgtgggcagacactccattcatttatgaatgatctgttgggaacctactgtgcgctggggctatctgttgagactctaccatgttctgggaaagtcagccagcacagcttcctcctgcctttcctggctctttctctccactgctgcctctctactctcttctggtcacaccctcacatctccctcttacatcagtttttcacaaaccacccaagcccaataagacttcacctggctggggtttaggatagagtctttctcagaagcatgttcagtttaatgggggacttctgaaaaccctagggccacaaaagccacagaaagggcaacataatggtggactttgggggagatctcagctcaagaggcccacagactgtgctgtaggaactggggagcagccaggtttctggagcctcctagctttccaccagtagcctggcctgaccactctctactcgccccaggtgcttcccgtctgccgtttctctgccttggggctccactcctggctgacctcctggcatctggtcagatccatgcccgttgccctctgcttctttatcttggtatctcttggcttaaatcctttatggatggactaagtgcccaagagtgccttttcatggtggctactctacaggtgtctggtgggctgaggatggcccagccttggatcaaacagccccctcagctgacctgccccagcccaggggatgggggcatcacacatataggtaccacctggaaggcactcgccgtggcagatacggtggcctttctgtccaggacaagcaacaattgtttttgtaataaggaggagagaacaaaagagagactgcgagagagagagggagagcgagagagagaaagagagagagagagagagagcttgtagaagataaaagctctctgcaccagagaggatgttcccatcctgcctccctcgcttcctgccttaactcattctacacacactgactgagcgccctccatgttctgggacctgattcagctactcttcctagtccactgtggtcttgtgaggtcagcgcttggtcaagattaggagaaaaactgcagggctgcagagacctctctgtccaacatctccctacgtgggcactactctgctgtgagctctgggtggacaccaggcatgatttacaatccctttcagggaattattgctgctaatgggcagagccaatttatgcttcccaagggggagggcaaaatcaattaatggagagcctgacatggccaggcctgatgacagagtgtggcctgacatccggaggtgataagggactttctgaggctgaactaataaggagattggggaaaaagaagaaaaacaacaccccctccccatctgcccaatcgatttggtgtacaatgggcagagaatgcagagtaaacagagcagctgggcacgagcctctttccatctgaacgagcctggagataaggactggacaggccgcccatcccaccatcaacataggtattcgctatggagcccctcaatagacatatccatatgggtgaaaaaggacactttccaaaccagaacacaggggagaagataaggcccacctgccccaggtgtgtgccttgtagtagaaagggcaagtggagacagagagcactggttttagatgccagctccctaactgtgccccccagatagtttgcaccacgtggctggagcggcaagctttcgatgtgggagcctgggctcccggagtctcccccacagcgtcctacgtggaggcggcggtggcgcgggtttgtaggggtctttgtgtgtcctcgtgagtatgatctcagaggtgggccagctcgtgctgtgaccagcagacagaccagggaaagctgaagggtgattcaaggtaaagccttgaaacagacaaacaaacacacctgttactaattttgctcagaaactgcatctttcttttttttaaggagcaggattcctcttgcacatgaaatctttcccagagccccaatctgaagcctacttaagagtggagctctggttgaagtaggggcagagggctcccatttccaccagcccagagagtgtgatttcaagagcccttacccgtaattctgaaatggatgcccttgtctaagttggacttccctcagcgcaggtcccaagacacaatgcgggtgtgcgtggttcatctgggacctgatccaggatgcgcaagcaggggagtggggaacagaaggcagtcgattcagggtgtgttttcgcacaggtgactgttgcgggcaactggggccccatcccgctggggacctctgggagactgtgcagaacacactgtagagttgttccacagagtggcaaggaagctggggtgtttatctaccaactcttgtcccttgttaattgaagattgctcctggggaggttaactcctgcactgccagcctgccctgcctgtgggctgagagcactcctgcggccagagagtccctgtgggtagaaagatgcaggtgcttaggacagaatgctactggtatagatggaggctttccacaagtgctgcatgtgacctccaggcgggctggggggatctggcagagtactgacactgtctgtcacaggctctagttctccactcctttgtctgggtcactgtggttttgtcattcctgcagggaaattgctcttctgtgaaccttaatgaaggggtggtcagcttgtcctggcatattaggccggtgcccttggaagcatgacaagagtgggaagaccataccctcatctcttgatggccactcaaattgaaaaaagaaattgtttttattgatttatttattttgagatggagtctcactctgtcgcccaggctggagtgcagtggcgcgatctcagctcactgcaacctctgcctcccgggttcaagcagttctctgccttagcctcccaagtagctgggattataggcagccgccaccatgcctggctaatttttgtattttaagtagagatggggtttcaccatcttgtccaggctggtcttgaactcctgacctcatgatccaccctcctcagcctcccaaagtgctgggattacaggcgtgagccactgtgcccggccatgaaagatattgttaaaagatctgctggccatcccctgttaatgaatctccctacatcccctcacctcttcagactataagaaaaacccatagctttgagagtcattggagctgcagcagcagcaagaagcctgggctgctgtgagccaggatgtagatgaggggtgccgctgagacagggaggagcagagcgtccccagggcctgggagagatactgagcccagaaaccagaggagagacagggccagctgctcttggtgtgtgagggtcctggcaaatatttttttgtggatggacccctgtgtgtataaacaatttgatgaaaaaaacttagtaccaaattcatgagcccatgtgaggtataatgattgatttgtgtagatttagaataatgacagagaagaggcacttaggcatttgtttattgtctaattggttcacatgacgattctttgtcctatgatgttaagagtccatcaaatcagcatgttagcgcaggtctggtggcccaatcccaggtagtgccataaaagaaatgccacaccagccagcgggaatgatctcctcatcaggctgctttcctggaaccagggactgactaggaagccctaaaacagcttcataggcataagtcctagagcaccttgggacatctggtcaaccctatgcatgcactggagaacttcctgaaagaagaaaagggaactgagacccacatgaggcctggactatgttaggggtggcctgcatggatgacgttgttggtcatggctggtcccagcaccagagggagacttagaaagtttttagcaaagcatgtcaaagcacaggttacccccaaaacatggggctgaaggcatggggactgcttgcctcagtctaaagacagtgatggaaaagacaaacccaggagatgtttcggagaaaagaaaacaacaacatcccacacctggggccagaaggggaggggtgctggcctggggaggggctgccctcctgagatcaggagctgagtgaatggagagggaagagtaccagctggcatgctgcttgctctttgctgagttccctctcagtgtgggtgaaactggctcagccctgctggctggcacgaggccatggaaaacccaaataaagcagttaactctgaaaaggttgctgcttcctcctattccttgggagatgcattcagggctacactcagaggccacttttcgcaaggtgaggaggagcttgtattcaaggaaacactgctttttcctcccacatttgacacatatgttttcaacatccaacattcacagccaacctctctacacctgctctgcctcggagccctggcagtccctggacacgtgttatggaaggaacactgtctcccccacatgctcacatggcccaaatccccacaagtcccctttttgccaagctccacgtcctttgcctcttcccatcacccaatacccaacctgccatcattgtcctaagcttcccttccctgcttctctctttgcaccttgccgggttctcacactcccacccaccttgatagtgagtccaagcccatcctaccccacccccaactccttcttctttttctgagacagggtcttgctctgtcatccaggctggagtgcagtggtgtgatcacagctcactgcagccttaacctcctgggttcaaggatcctcccacctcagcctcccgagtagctgagactacaggcgcttgctaccatgcccagctaaccccaactccttcttaatcagattgtcttgcttacttgtttattgtccctctctttttttttttttcagagaaggagtctcgctcttgttgcccaggttggagtgcagtggcacgatctcagctcactgcaaactctgcctccagggttcaagtgattgtcctgcctcagcctccagagtagctgggattacaggtgcgcaccaccacacccagctaatttttgtatttttagtagcgatggggtttcgccatgttggccaggttggtctcaaactcctgacctcgtgatccgccagcctcagtctcccaaagtgttgggattacaggcgtgagccaccatgcctggcttgtccctctccttcgttagaaggttccaagaatgctggcactttctctgtctctgtcacctctgactcctcagaacttagcacaatggatggcacatccttgtcaaaacaatgaccagatgaatgagacatgcttatgtttaaggaattacaaggagcattttttctgcctagatttgaaacacacacccattgcattttaaaaaatgtttctgtctatttactctatcaactgtgccatgcctggggctgtttctatttgttttttcttttttttttttttgagacagagtttcactcttgttgcccaagctggagtgcaatggcacaatttcggctcactgtaacctctgcctcctgggctcaagcaattctcctgcctcagcctctgagtagctgggattacaggtacgcaacaccatgcccggctattttttgtatttttagtagagacggggtttccccatgttgaacaggctgttcttgaactcctgacctcaggtgatcctcctgcctcggcctcccaaagtgctgggattataggagtgagccaccacacccggcctctatttctattgatggttttttctcctctcatggcccatattttcctgcttctttgcatgcctgattattttttaatggacaccagacattgtggattctatattgttggatgctggtttctttttggtttgtttttcatattcctttagatattttgaagctttgttttgggactcattgaagttacttggaaacttactggaaacaatttgactcctttggggctggctttttaagctttgttaggtgggaccagagcaatctatcatctaggactaatttggccccacttctgaggcagtaccttatgtgtctctatacaatgactgttttgggaggtttctccactctggctgttggaaacatgaactcttcccaacacagtgttatctcaggaaattattccacctgcttcctcctggtggttctttcccctgccttgggtaatttcttcacatgcagatgttgatcggtagttagctgaagactcaagggtaaccctctgaagatctccagagcatgctctctctctttctctctcttttttctcctctctctctccttctctctctctcatccctgggactctgccttgcaaatttaagccactttgtcctccctggattcccagctccatttcctcaactcagggaaaccactgggctctacctggttcccccttcctgggctgcagcctgaaaactcactgcaggcagtaagttggagcaatcatagggctcccctcacttgtttcccttctcttgcggatcaatcataccctatattgcttgttatccaatggctgaaaaccattggtttgtatagaggattttgtctcatttttagtcatttaaagcaggagggtaaatcaggtccttgttgcttcatcatggctgtaggtggtggtcctgcttttccatatacaggatgctctcagtgcctttccacaggctgcatggagagacaatgaactctgcactgagaaatcctagatccagtcatatactgtctctgggttccaatttctgtgccagtctgctattgctacaattaatgctatataacaaaccactctaaacctcagtggtttatgacaagcagcatatattctcatgccaataggtctttgggtgagccatagttcagctgatctgggctgggcttgcctgggaggctctgctccaggctgtagactgggctcaggtctgctctctggatgttccaggctgaaggggcagcagctacccatggcatgttcatcccaagagagatcactggagcaagaggcaagctcaaccatgagagcacaattcaagcctctgcctggatcaggtttgccaacaccacattagtcaaagtgggccatgacaaagctttggatgtgtaattctatactggtggtgaagaattaaaatgatgtattcagtataccacaatttctctatctgctttctaaaactcctttttagcaagatctgggcaagctacattttaacttccctcctccaacctccgtccaccctacttcttgtcaagggattggtagagccagttgaattctagcagggactgggctggagtcactggctaggctgctttccagaaaatgtttttgaaaatcccacattttggcctagagtgaactcagatacttcttgtcatccgtggctccactgatcccaggtggattgctggaaagtcttttcaaaacattgcatcaatttctcccatttgcagaggccagtgaactctgggaaggtgcactgctgtcaagcatgtgtccatatcaaaggctgggcttccattaggggatgttcggagcaaaaggccccttggccagttgctgcacacactttgcatatgctctggacaccagtggccccagatcccatgttgtgtgtttttctgtcttcatttcctttcctgtcttagtgattgccccaggaggctggttcacaccccgcatggggccatgccacacatctctgtcagtaaggcctttggatccaggagatgatgtctcagtgggagatctaatgttgaaagactctggcagggtatgtggctcatgcctgcaatcccagcactttgggaggccaaggcgggagcatcgcttaaggccaggaatttgagaccatcctgagccacacagtgagaccctgtctctacaaaaaatttaaaacgagctaggtgtggtggtgcatgcctgtagttccagctactttggaggctgaggtgagaggatcgcttgagcccaggagttggaggctgagtatggcttgagcccaggagttggaggctgactagtgaggtatggtcgcaccactgcaccccagcctggctgacagagaccccccccatctcaaaaaataaataaaagaaagtaaaaataaaagaaaataaaagttagtagactctacccagctctagagggctgagggcactaaggcatgccaagaatactgctgctgctacataggggactggggcaaatgccatgccatcttcagggctcttgagagtgtgtgtgtgtatgtgtgtgtgtgtgtgcagttacatgtgtgttccatggactcttggggaggcttctagaatcagaatttggtcttcctctggttctacagactttacagagggcttactatgttccattgaactgtgagggccaggagtggaccagagatgctggcccctgtcccgatgggattcagtcagagcctgggggaagtcagagtgacaccagcctgagaaacacatctgggttctggctcgtctactcatgaactgaaggaccgtttactgaacagcgactctgtgcttgggacacagcaatgagcaagacaaacaggtccctgttgcattggagctcttagtattatggggggttgcaggtatttcaaaaataggcaagttcggaaggataacatgtcagatagtgatgcagaaaaaatggtaatgggataggggataactagggggtgactcgagatggagtggtcaggggaagccccctgaagaggggacatttgtcagtggcatagaacagcaagctgaatctccccttcactctggccttctaattatataaaataggggtgtggattagaggagctcgatgggcctgcctagcttagaaatgtaatggtttaatcttctcctgcatgatcctgttacccagtcctaaaaaacgaaaaagaaaatcaagccaattatactatattaccactctgctcccctccagggtcatcaggtcctgtatttataggacagagacaccaggagcagtggaccagcacttttatccagttagcttcatttccaggtgccactcctgctcaccctccgctgcccctccctggctgcagctgggttggaaccccctggcccagggggcagttcttcaagaacctccttgagggctgcccaccttcccttggatctgtcatggagagggcccatggagacaagacccccaggcagctatgtttttccctgtggaagtggggagtgtcagcccaaatcctcccaagtggctgggtgaaggttgtgaggcccaaggtacccacactgccctctctcaagctctcagcagagcccctgggagctgcccactgttctctgggtgctatgatgtccttagaccctgcagggcagatggctccctggagacacagctgttcaggcactgcctccaggtcatcctggccaagaggctgatggtgaaagatgtggtctgggagatcaggattggccttcaggatgccctgcattccactgccttgcctgtggctgggacatcctgcctggacctgtcatggccatttctgggcttccaaaccagagcacgggccaagggagagagctggcaaatcgttaaaaataaaaatattccccccacattccactggtg

SEQ ID NO: 207 - DNA, 10000 bp, Homo Sapien
  misc_feature 3144, 3145, 3146, 3147, 3148, 3149, 3150, 3151, 3152, 3153,3154, 3155, 3156, 3157, 3158, 3159, 3160, 3161, 3162, 3163,3164, 3165, 3166, 3167, 3168, 3169, 3170, 3171, 3172, 3173,3174, 3175, 3176, 3177, 3178, 3179, 3180, 3181, 3182: n = A,T,C or G
  misc_feature 3183, 3184, 3185, 3186, 3187, 3188, 3189, 3190, 3191, 3192,3193, 3194, 3195, 3196, 3197, 3198, 3199, 3200, 3201, 3202,3203, 3204, 3205, 3206, 3207, 3208, 3209, 3210, 3211, 3212,3213, 3214, 3215, 3216, 3217, 3218, 3219, 3220, 3221: n = A,T,C or G
  misc_feature 3222, 3223, 3224, 3225, 3226, 3227, 3228, 3229, 3230, 3231,3232, 3233, 3234, 3235, 3236, 3237, 3238, 3239, 3240, 3241,3242, 3243, 3244, 3245, 3246, 3247, 3248, 3249, 3250, 3251,3252, 3253, 3254, 3255, 3256, 3257, 3258, 3259, 3260: n = A,T,C or G
  misc_feature 3261, 3262, 3263, 3264, 3265, 3266, 3267, 3268, 3269, 3270,3271, 3272, 3273, 3274, 3275, 3276, 3277, 3278, 3279, 3280,3281, 3282, 3283, 3284, 3285, 3286, 3287, 3288, 3289, 3290,3291, 3292, 3293, 3294, 3295, 3296, 3297, 3298, 3299: n = A,T,C or G
  misc_feature 3300, 3301, 3302, 3303, 3304, 3305, 3306, 3307, 3308, 3309,3310, 3311, 3312, 3313, 3314, 3315, 3316, 3317, 3318, 3319,3320, 3321, 3322, 3323, 3324, 3325, 3326, 3327, 3328, 3329,3330, 3331, 3332, 3333, 3334, 3335, 3336, 3337, 3338: n = A,T,C or G
  misc_feature 3339, 3340, 3341, 3342, 3343, 3344, 3345, 3346, 3347, 3348,3349, 3350, 3351, 3352, 3353, 3354, 3355, 3356, 3357, 3358,3359, 3360, 3361, 3362, 3363, 3364, 3365, 3366, 3367, 3368,3369, 3370, 3371, 3372, 3373, 3374, 3375, 3376, 3377: n = A,T,C or G
cagtgggaagaccatgagaagacacagagaggacagccatctacaagccaaagagtgaggccttggaggaaatcaacctagacagcaccttgatctcagacttcaagcctctagaacagtgaaaagataaatttcgggtgtttaagccactcagtgtgtggcactttattatggtaacccaaacacactaagacagaggtgaaggggtcatttgcatgtctatagatgagaatcattttaagttcccattagttacctataatttatggagtcgtagaatagctcccttagaatcagataacccaccccctggcagccaagtgccctggtgcccacccccgtcaagcccgaaagatggggaggtggggtggcaggagtttctgtcccccatattccatacacgtccccctctcctccctcctagtgagcaggggcctgcaaggcatcactcccagcccctcgccctcttgggcaccctcagcaaaggggcgggtggggacactccaagtggggcagctctccctacacgtgccccaaccccatgagccagttcaaccctatcaggggctgagcaggggcatcccctccttttttcatagtctccgtggatgtcctcgccctgtagccacaagccccttgctgctctcctttaatgccaaagggcccctgcctaggacacaggcccaacctgtgtggtggggtccccagcagcaaacactggaacgtcttttttcttttgctttcttcttccccaccccttaattttaactttgtggtaactaagtgtccctgagtgccagctgaatgtgcgggcggcagtgccgttccggaggcctggtccatctgcagttttgaggggtgaggggaccagcgtgggggttagttagcttcccttccccacctgcaaccagggactgcccgggtaactagctttgatcctgtctgctccctccctgatccctcccctgctcatgtcccttctctatgaacttaaattgaaaaccgcttccctccatctctcctcccgctcccatgtggagggggaatgtgtgctggccagggtggaggactgagcacctgagcctggggctggctcccccggggtccccgactcagctggtggctgtggagctgagtcccctccccataacccctgggaggccagcacccaccatcactacctgcacctgctgtggtcccaccttctggaggcctgggaacctggctgcagactgggaaggctggagaggcagacggcagcacccaccagctctcttcccaccctgcctcttccccgggagccatgccctacctgtgtggtgctgggtgggctgactgtcaagacatgtgtcatgtacatttgtatcagaaataaagaagtgaccacacacacacacacacacatacacaatcagctaacccagtcagtttaataataagagttaatttatgactagaatcagcaaactgcttgtggtcaaatctagccctactgcctgtttttgtaaataaagtttgttttctttttttgaggcagggtttcactgtgtcgcccaggttggaatagctgagactataggcatgtgccaccgtgcccacacctagctaaagtttgtatttttggtagagacagggtttcaccatgttgcccaggctggtctctgaaactcctgggctcaaagcatacacccgcctcagcctccaaaagtgttgggattacaggtgtgagccactgtgcccagccaataaagttttattataacacttatatatggctgctttcacaagacaaagacagagttaagaagatgcatccgcaaagtctaaaatgtttactacctggtctttttttttttttttttttgagatggagtctcgctctgtcgcccaggctggagtgcagtggcgcgatctcggctcacggcaagctccgcctcccgggttcagcccgttctcctgcctcagcctcctgagtagctgggactacaggcgcctgccaccacgcccggctaatttttttttttttttttggtatttttagtagagacggggtttcattgtgttagccaggatggtctcgatctcctgaccttgtgatctgcccgtctcggcctcccaaagtgctgggattacaggcgtgagccaccgagcccagccactatctggtcttttacagagaaagttgtagagccttctctagacaatgcatggttttccattgaaacacaaatgtttccctacaattggaaggtcattcaaggtcatccagctcagggattcctagattttaagatcttatgggtaaaatttcaaaataaaattttgaggatagttatagggtctctagtgtttacttttgtcaaatataactacctcatgaaagaacacattttaactactcatattttaaagtgaatagcatatgaaatagcatatgaaatcttgctgcattattctttctttaatttctctgagttttggtaaaaactccacccctgaacagacagttaatggtctagattgtggaaccattgacctggcccaatctcaggcactagctgctggctctgtccagaaaggctgctggcttgggcccagagtcacggccttactcctgtactcaagctgatgccctctggggagaaggggcgtgttctctggggggtggttattgccagagccagcttgtgcatgtgtcacacaccccctccaatgatgatgggtcttgcctggctttaaataatatgttttttcctaattaaaaaaaaaaataaatgctcagtgcagaaaacatgggaaaaaaatggaaagtacaaaattcatcttcactcagagagatgtaaagatttactgatacacagggggattaaaaacagtttgcaatctaaaaatcctaaagagacaaaacctagcatatgtctcagaactatcatggagcctggcacatggcagacgccaatatttattgacataacaggccaggcgtggtggctcagaatgcctgtaatcccagcactttgggaggctgaggtgggtggatcacaaggtcaaaagtttgagaccagtctgaccaacatggtgaaaccacatctgtactaaaaatacaaaaatttcctgggccgttggtggtgggcgccagtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttggccaggctggtctcgaactccgggactcatgatctacctgccttggcttcccaaagtgctatggttacaggtgcaaaccaccatgccagccaatttattttttaataatctaaatagctaatatggtcagtcttccaggtaaaaaaatacttgtgcttatcttttttccttatgtactttgtatcattttttcccttttaagatttatggctgggcgcagtggctcatgcctgtaatcccagcactttgggagaccccggtgggcaaatcacttgaggtcagaagtttgagaccagcctggccaacatggtgaaaccccatctctactaaaaatacaaaaattagctaggcgtggtggtgcatgcctgtagtcccagctactcgggagctgaggcaggagaatcacttgaatccgggaggcagaggttgcagtgagctgagatggcactatcgcactccagcctgggtgacagagcaagtctccgtctcaaaaaaaaaaaaaaaatttataactgccaagaaaaacaatttaagaagcaaggattatttgtgttcattagttttcatcatattttactgtctgaacaatttatttaaattgtcttattaaactgccctaatgatacatgcagtatagtgatatttagaaattgatctagtagacttcaattaatttatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaaaaaaaaaaaaaaaaaaaaaaaaaaaaaaaaaataattatatttaaaacaaaaaattgaggctgggtacagtgtctcacacctgtaatcccagcactttgggaggctgaggcgaaaggatcacttgaggccaggagttcaaaagacctgcctgggcaacatatctaccaaaattaaaaataaaaataaaaaattgagaacaattttcaaccctttgtggcttgcaaaggtaaaattaataacttcatactatttcctataaaaacatcattcatatcttctgccttgcacagctgttctcagccccttcccgcagtttattaactccatctcctcctttgagaaacaaacattcaaaataatccctgataaactggaagaataaaaatgacttctccctggttcttctttgtctaaatatttaactcacatatatctttgtttcccctgacatttcattatgtttaatgagattttctattaaaacataaggtcattttaacttttaaaaaataagcaagcatcatgtcttttctttctttctttcttttttttttttttttttttttaaatagagtctctctcttgtcacccaggctgtagtgcagtggtgccatcttggctcactgcaacctctgcctcctgggttcaagcaattctctgcctcagcctaccaagtagctgggattacaggcgcccaccaccacacccggctaatttttttgtatttttagtagagatggggtttcaccatcttggccaggctggtcttgaactcctgaccttgtgatccacccgccttggcctcccaaagtgctgggattacaggcatgagccaccatgcctggcccagcatcttgtcttttcaaaaattacatccttcctttgatgaggcaactggctgcatctgatttaaatctttccttaaccccccagcccaacaacaccctgcacctatcccttgcatttctccacccctcgaacatttaacctcctgggtcaggcctgcccctcacctgcccatgtcatggtaagcctcctgcactctgactcgatccagatgggagcccacatatgacagagaggcctaggagcagccttggaccctaacttccccactcattctacttagatttttctttcactgtgtatgaaaattttccttctcaactacttccagggacccagatctctttcttctcttacttcctctagaacttttcattacggcgtcctggttcaggccttagtggttttgtcccctgatcattccctctcaatccactgttactggccacagtcttcaacagattatgcccctcctgtgtgcaagtcatgcactactggcttcatatacctgatttctggtcttcacaacaaccctgtgaagctgtgggacttgaggtacaaaatctctatgagcttccatttcctgatttagaatgtgaatattaacactaacaggagcctacattctgtattccacaccacattacctttcttacatggctgtcttttctctatgttgtccccaatgccacactgtgtataattagatctcaagacacacttggttatttttatttactatttttataattattgactactgctatggtttgggtctgtgtctccaccaaatctcatgtggaattgtaatccccaatgttggaggaggggcctggtgggagatgattggatcatgggggtatctttcccccttgctgttctcatgacagtgagtgagttctcacgagatccagttgtttaaaagtgtgtggcatttgtctccctcttcctccttcagcagccatgtaagacgtgactgcttcccctttgcctttagccatgattgtaagtttcctgaggcctcagccatgcttcctgtatagcttgtggaacagtgagccaattaaacctcttttctttataaattacccagtttcaggttttttttttttttttgcagttgcaaggtttaatagtgaagacagagctcccatacaaagggaggggacccaaagagggtagccattgccggctcgaatgcctgggtttatatcccgctgtgctctcaggcaatagatgattggctatttctttacctcctgttttttgtctaattagcattttagtgagctctctctactatctgattggccaggtgtgagctaagttgcaagccctgtgtttaaaggtggaagtggtcaccttcccagctaggcttagggattcttagtcggcctaggaaatccagctagtcctgtctgtcagtcccccatctcaacaggaaaacccaagtgctgttggggaggttggccgatgatggctctaactgcttcctgctgaactggggcatagtaggggttgtgcagttgagatttccttgggaggggtgcctttgatgtcattaacatcggagcatgggctagcaggctggtccaggggtctgtggtagatcttagtcacggacagcatctggggctccatttgaagaatgatttgtagttttacagcttcaattctggaagagacaaacttaacaaggaggttaaagatacaggctccaaagaggagtaacaatattattgctgctagaggtcctaagaaggggagaatccagggcatccattgactgaggaggccccaaggtccagtgttttgaagctcctctgctctatgttgtattctatctcaaatttctttacctttctcggtgatgattccggattgattaacataataatagcattcttcccctaaaaataaacaggttccccccccttttggcggttagcaagtctaaagctctttgattttgaaggactactgctgctagggagttaagttgatcttgcaaggtgaccagggagtcggcaacccattccatgtcaccatttagttcttgggatagtttgtagtagaactgagtagaggttgtgatactgccaatgccagcacctagtccacctagcactcctgctctgataacaaaaggaagaatgggtactcttttgttgcagggcttaggtacaacataattgtataaatcttgttcagtgtagatggtcatagggggcactaagaatgagaggaagcacatagattctgaagagccattcaaacaacgataggctgaggtgccacagacaaaaatattcctgggggtaggcagactattcctgtgggaggagttattcacctgatgcattgggagttggttgtgtctatagtattgctaaattttacataggtgaggtttgaggtatgggttatttccagattggaaacaagaggtcctaccaaaacggaagtggtgtttatttctgtgctgaagttgttccattgttcaggtacagggattgaaatgtatgacctgaagtgcagggggaggcacatccaacagttagtagggttttgggctgagacctcatggagcccagtgagggcggtattaaataggcttaccaggcgagtatgggtacagagggtttcatgtagttttgagagatctagtcctttgtaggggctaggggtgctatgtacccaggtcagttgggagattacttcctttacgtgtttttctctagcctgatcttgaactccacccctatcagacatatcagtatgggtgaagtaagtccaacagacagtggctccaagtcctccaggacaactaggattaatcttttttttttttttttttctgagacagagccttgctctgtcacccaggctggagtccagtggctgaatctcggctcactgcaacctcctcctcccaggttgaagcaatcctcctgtctcagccttcctagtagctgggattataggcacacaccaccacacctggctaatttgtatatttttagtggagacaggattttaccatgttggccaggctggtctcaaactcctaatctcaggtgatctgcctgccttggactcccaaagtgctgggattgcaggcgtgagccaccatgcccagcctcaggtatttctttatagcagtgtgagaatggattaatacaactacttattcagttattttcctaagttagttctaagatataaaacagatttgcatttaaagtttattgaaagcagaggcaattcacactaaggaaccaatgcaacaagacatttttatttttttatctctccaaattttttgtccttttaaaaactgagatatttatctttaattattagtttgcatttgtccctctgccagctttaaggcataatcaacaaataaccaatgttgtttttaaatgtctaacgtctataaagcccaatcctgagaactctaccattggagtgctctggttaattggatttctgttaatcaccaatcagtttttttgttaaaagggacttgttcaaaacttaaccaaactttaatttactttcttacttcaggaaaaaaaaaaatctcctgggcacacttctatcctgctttggtgacacagaaatctaagcatcctaggttaggatttggagcattagggagcatgctgaggatggaggaggagcgggaaagtgagccgcaggtgcaccggccgaggcctcaactctcagagggcttcttcttaacttgttccaggtgtggttaatgctgtcttgtagatgagtattactgttattcagattccagttaaccaacatttttttgaccggcacttttgcagctcttgaatccttaactcaagggacaaaacttttaaactgacttcagccaggttttttttaccactgggataaatttagattttattatgtgcacatacatccttttaaaaaatatcactcagctttatatttgtatcccaaatattttttcgcagctgtagaattctcaccttggctgtgcttttgagaagtgctaattctaccatacagtgttggctgggcagccacttgaaatgatggttagtattttttcaattcaatttcttttctgttttttttgttttgttttgtttt

SEQ ID NO: 208 - DNA, 10000 bp, Homo Sapien
agaaaatctttaaaaagcatctgaaaaggtgttcaacatactattccctcagaaaagtgaaactaaaatcgagtgataccaactaggcacttaacagatggctaaaatttaaaagactgattagtgctaagtgaagacaagtggaactcttctaccttgctggtgaaagctgaaaaatgatacaacattttggaaaaccggcagtttctactaaagctaaacacccactcaatgacccaacaattccacttgcaggtatataaccaagagaaatggatgcatgtgcatgccaaaaacatgtatggcaatattcacagcaactatattcacaaaaagcaaatccttaaaacaacccaaatgctcactcattcatacaatgcaataatacacagaaaaaaaattttaaacctgattgcctgcaacatcaatgaatctcaccaattctttgaggaaaagccaaatacaaaagacttcatattgagaccacatactatgattctacatgaatgaattaaatgggaaaaactggtctatgatatgacataaatcaaaatagtgcttataggtagaggctacagacttcacaggtacaggagggaatctcatggcctttggaaatgttctcttgttgatctgagtgatgactacaagggtgtacagtggtccccacttatgtatagtttcattttctgtggtttcagttacctgcagtcaactatgatctgaaaatattaatattaaatggaaaattacagagataaataattcataaattttaaattgcacattctcagtatcatgattaaatctcctcttgtctctctctgtgccccctggggcatgaatcatccttttgtccagggcatccatgctgtctatgctcccctcccatgatcacttagtagctgatatggtttggcgatgtccccacccagatctcaccttgaattgtaatacccataatccccaggtgtcaagagagggaccccgtgggagatgactggatcatgggggcagtttgccccatgctgttctcctgatagtgagttctcacaacatctgatggttttataaggcagtttttccagcttttgctagctctctctttcctgccatcatgtgaagaaggtctttgcttccccttcatcttccgccatgactgtaagtttcctgaggcctccccagccacgcagaactgagtcaattaaacctcttttctttataaagtacccagtcttgggcagttctttacagcagtgtgaaaacggactaatacagtagccatcttggttatcagatcaactgttccgatattgtggtggttggattcaactaattctttttacttaataatggccccaaagtgcaacagtagtgatgctggcaattttgatacactgaaaagctgtgaagtgcttccttcaagtgaaaaggttaaagttttcaacttaacaagaaaaaaaatcatatgctgaggttgctaagatctaccattaataacatattttctattcctgaaattgtgaagaaggaaaaagaaattagtgccagttttgctgttgtccctcaaactgcaaaacttatggtcaaagcatgtgacaagtgtttagttaagatggaaaaggctgagatatgaacagaaacatgttccaattgaaagcaattgggtgccacactatccatggtttcaggcatccactaggggtcttgcaacttatctcccttggataaggggttaggggggactactgtatatatacataaaaatcattaaactatacatttaagatcagggtactatatgcattttatgtgattcctcaataaaacagataaataataaagccataactcacaaggacaaatagggaagatgaaaagtcaacagtacttggtgtcaaaaaaggaggcagacaagtgaaaactcccaaaacacacttgagaaaacagatgctttaaactgtcagtgggaaaatcagagacgcagctgcacttacgtcacatcaagaacctccaaaggcataagaattgatggaattcaatcttcctatggaaaggaagtagacaaagagctgaaaaaagaggactggttgaaagcctatttacaaattagcaccctcagatctttcctacaccaagcaatcaggacgctgtttctctacagccctgaaagactgagtgctttgatctagaagagtgtaaaataaagtgaggataagaaactatcaggcatgattaagggtaaaaaccaaaagcagggggattaagtgaaatgttacacattgattattgagacccacagccttcttccccacaacttggtaattagagttttggctgccaggtacccctcaagaaaggagattggaagttatcttcttgaggaatctgatcatcaccaagaagaaagacacaaagaatagtgacagtgagagttccctaaggaaaactgtccaagcaattcaccgttcagaagccatagttgataggttccacccatagaatctcagatcagctttctagtgcttcactcacaagcacacactcacacacagacacacacacagcccaggatcacaaaacatgaggcaaacatccagtataaaggattaaaagaagagcaatgtaatttggttgaaatggacaatgtgcaggaaacgtaaaaaaaaaaaccctatcatttatatcaacataaagaaaaagaaaatatcgcatccataaaataaaaagtgggatgcgtgcatactgaaagaaggatattcgagtgacaaaaggaactccgggaaattaaatatttaaaacgcaggaaggaaaaactcaagaaggatgaggtcatacaattatagaaaatgcccagaaagcagagcaaaaagacagagatgaaaaataggcaataataaataagaaaattaggacccagtctataaggcatatcatttgaataataaaacttctagaaatatgtgaggctgaggcgggcagatcacctgaggtcaggagctcgagaccagcctgaccaatatggtgaaaccccgtctaaaaatacaaaaaaatttccagggcatcatggcatgcacctgtaccccagctactcaggaagctgagacaggagaattgcttgaacccggaaggcagaggttgcactgagccgagatcatgccactgcactccagcctgttcacagagcacgactccatcaaaaaaaaaaaaaaaaaaaaaaaaccaaccaacaaacaaaaaacctcctagaaatagagaacagagaaaaaataagggatgaaagaattaaagaaataattcatagaatttcctagaattggaaaacatgaatttcctaatttaaaaagaccaacaggttgggcacagtggctgacacctgtaatcccagcactttaggagactgagacaggaggatcgcttgagtccaggagtttgagatcagcctgggcaacatagtgagaccagctctacaaagaaaacatcagaaaattagccagacatgctggcgcgtgcctgtagttccagctactcaggaagtgaggcaggagaatcacttgagtgcaggaattcaaggctgcagtgagctatgatcacaccactgtactccagcctgggttgaaagagcaagaccccatctctaacaaataaaagtaaataaaaaaaccaatgggcaaaaaataagaaaaaaaggggaggctgaggtgggcagatcacaaggtcaggagatcgagaccaccctggctaacaaggtgaaaccctgtctctactaaaaatacaaaaatattagccaggcgtggtggcaggcgcctgtagtcccagctactcaggaggctgagacaggagaattgcttgaacccgggaggcggaccttgcagtgagccgagatcacaccactgcactccagcctgggcgacagagcaagactctgtttcaaaaaaataaaaataaataaataaataagaaaaaaagatttcacaccaagaaacataccatgacattttagaacactaagctcaaaaggatcatctttaaaatacttacacacaaaaaaagagagagaagtaagagtgctaaggaacttcttaaaggcaacaatagaagaaggaaattatacatttaattcataattctgagtaaaaatagcttctaaacccagccaagtgattgctcagttattacatcttctgtttgctgggtaccatgtttgatgaaaggaatcccaagactgatgatgagtttccaagataacaattaggcaaacactccagggtggagtaggagacaacagaaaagaattttttaagaaagtaaaactgatagaatacctaatgtgattgtaagctctgaaaaaagatctacacaactgtgagagtattcagggttccattagtaataattaaaaactaaggattaactctagggaaaatgatgttgagcaagaaataaaaagtaatcataatgtactaaatgtttcagttttgattggtgtcataatatacacaatgaatctcaatataaacaaaattatggtacaaccatattgaaagatgggaagatggatggataaaaagtttatgtgcatgcgacaaaggatgaaagagataaaacttcatctttctcactgagaagttaatggacagtgcctaaaactgaaaaagtgccaatatattcgcactgtttagagtacaaaaaagaccaaaagaattgggtaagaaaaatgatacaagctgactttgggaggaaggggtaagatttttcttaaatctatgtgtatgatagaaaatttaattactattaaaaaagtaaatggaagctttagagcaactatgtcgaacagaactgtaatgcaagccacatatgtaatttatacttttctaataacattaaaaaggtaaaaaacaggtgaagttaatttcaatgatagtatcttatttatccaaatatatcaaaaatattatttcaatatgcagttaatataaaaactttcagttaaatattttagctttcttttttttggtatgaagtcttcaaaactcagtatgtgttttacactgaaaagatagttcaattccaactaaccccattgcaagtgctcaatatccacatgtacctagtggctactgtcattagatgtggcaattcttttcctgtgatctcatgaaaacttacgatagaagaatttcactgatatgaaactattttagcagcaatctacactatgaaagcacagaagcatcacagaaagcattcattaaaattggtctagcttccgattaataatataactatactttctaacctgaagtgccactagtcagccttattatgcaacaacttcatggtagtcaacagaatatattcagtacccaatttagaaaataccatatacaattgaccatatacagacccacgtatttgctctaccccacaacccctatcaatattaacaatctcttctcctggaatactatcctgttgtgtcataagattgccacatctttccaaagaaaccacaagacaggcattttgtattttatcttcctcaggatacaaggaggcccagactaaggcagcagaaagacagcagaggttaaataggcatctgtgagttgattgggagcttcaccagcatcattaaatttgtccaaatgacttgaacagggtcttgaacaacactgtgacttggcacccacttttgtgctacatacgataggacaccactatccccacgcatcatttagagtacttaacatatgctggacagtatgctaggtgtttatctcaatccttacaaacaattcttgatgcaatattactattagtactactttgcagagaagaaaattgaagtttgcaagcattaattgccttagatcacctgttttctgaaagaccctggaattaagaattacttttacattttttaaaggttataaaaacaaagaagaatgtgcaacagagatcatacatggccccaaaagcctaaaatatttactatctggcacttaacaaaaaaagtttactgaccctgcactagtttacagaattaaatagtctgattccaaaacaaatcctctaaatcagggtttctcagtcttggcatggttgacattttgggttggataatgctttgttagcagcatccctgatctctgtccactggatgcccatagcagcaccacccctcatcccggttgtgacaaccaaaaacgtctccagacattgccaaatgtactttgggcagcaaaatcgtcccccactgagaattaccactctaaatggtcttcaaactgggggatgtgtgccccccaggacaaatgaagtcttccatgggacatacaccaacgacatgtgtaattttaagaaaaaggcttccagatcctttactcccatgagtacttctcactaaactgatctgcctgagaatatgcccattgtccagttatcatgctgatttttattccccaagatcctttcacaatcttccactttacaaaataaaggcatacttctcacccactcctattcttactatggtacactgccccaggatggaaaagcctccctaccaacaaacaataagtcgaagggctcaaagaccctcctttaatttaggcacaactcccactatccattccattaggacacagatttccagtaaacttctactcttaataattattattcattaaaatccatcaagtttttaagctattctaatcaactatttataataactcaacccaaaagaaaaattacaacttacagaattagttataggaaatttttaaacttagcttcaatttatataactattgttattaaagccatgtatcacagagattaataaaaagctttcaagcataaaaatgcattaccttaagataatattctgtggggtgggggtgataaaaaagtaaaattttttaaaaaaggaagtgtgtaaaatataatgtattttaaaaattgatggtgatggatataaaactacaaagatatgataccccactgaatacaggtgaaagaatgatgtaccaatattaaaatgttaatatcaataccatgtgggaaactgcattcttttcaactaacgcatgatgtaaaatgctgtaagttaaccaaaagtgtgcaagagggacagttttacaaaaattatttgggggttcacaagcaaattaaaagtactgctttaaaaatcactcacaactataatatatagcaaagatataatggacatggtctgtctctggccctcagaagcaccaaaatttactatcttttgttaagctctctatatgtgtctggcacccttctaaggttatccaatcctcactcttggaggttgatatctgattttaaaaatgttttacaaatattgagcagcttgcccaagaagagagctagtaaatgatacattcaaatcagttcatggatcagaagattatctgtcaagaaaattaaatgagctctcgcctgtaatcccagctactgcacaggctgaggccggaggatcgcttgggcccagaagttcaaggttgcagtgagctatgactgcaccactgcactccaaccagcctgggtgacagagcaagaccttgtctctttaaaaaaaaaaaaaaaagaaagaaagaaaagaaaaatgaaaatgaaaattagatgagatgtgtttgattccaaatctaaaagtcctactatgtttacaagtcagcagagtgagggaggggtgaagaaaacccagagtgtcccgtcgtagaaagtcatgtggcttaaatcttcaataggtagcatttgaaagtagaagcgaggcataatgaaggaatatagctagaagcaatatttaccttgggtatacgtttatttctaagcttattttacatacggtgtgatgaaagatttcctaataatgtgtcaatggagggaacaagatggctactgagaaagaagagtgtgcctgtgtgtaggggtggagtgggagggctaattccacaggattgcttaataaccttccttgctacatctccatcttaaagagaaaaaaaggatacacgagagaagagcctgggtatctagaggttatatataagtctaatggtcaatttcagtctaatctctggggaatctcaacacagaaagaaaaaggtttatattaaaatatcacatttttattttgtgactgggatttgctatatcctcagcggtctcagaaaatacattttacagaaataaggattggaggatggtgacttaaaaaaaagcctattctattcctaagcacaattaagtgtcaatcaagtgtcctgaaaagataaaaaccattatcacattatttcacattatttaattttcaaagttaagaagacaaagtctttgaaatgacaatctgatgtattaaacagtacctacaccagtgtacagtcttcaacaacaaaccaaaatctgttccgataccagtagttcacctaaattctaattttttaacgttctaataaaacacatttatttcaacataactacatgtatgtctgtgtatgtcttaaaaaatacccgagaaaaggtaaaattctgcattaaaatacctagcaatttagttcgattccataaacactgaaagaagtaacactctcacttaacagtcaacattacaagcagtctttaataataccgcatttaactccttagagctagcacaagttgatctaatgcctatttggccctttaccaaaaaagcggagggggctttgtctaacacctgtatacacctccctccgtagcatcccgctcattctagcttcttagggaaaccatagacaacgacgtttcagagagtgccagaggtgaagccgacccgaaaccacattacagaaaggcttcctgtttcaaacaggtccaataaagccaccaaattaagtctacgattataaagaactgcgaatcagaaaataattccatataggtgcagtcttctattacttttttccccactttcggaaatttcaaagaaaaattgctacattcttaaatatgaggccattatttcaaaggctgtaacaacctggaacgcaaattcgttaaattatgatacaataaggccaacctcgaggatcctcggtggactactagcgcacttccttacaattagaaagtgaaaaactgggtcagccctagagtcacgcaataatgctgcgtcacgaaactgcgcattccaagagaaacttttctcaggcccagaattaagtcggagggatccgccgcgcagctcaatccctaggaagcatgaaagaatgtattgtaaagagtaaaatcacgcgcaatccatcccaatataaccgcagttgttcgtgggccttcttgcagagaaaggctgcccaaccttgacggggccatgggcgctgcgggagggcaaaagaccacagagatctgcgaagccaaagtaaacaacggggttggggcggcgagaatgatcaatagcgatgctccgaaaggactccgcgataggaatcgagcgggaaggattccctccatcctaacagtccatgggttaagaggccgaagcttccctaaataccacactcccgcgagggaagggactgagaacaacttctcaaactattctctctcgaaatcgctcccttcctcgaaaattccatctctgagactcggatgaggtccccaccccctccacccttgtcccgtgaccgtcgcccgctcagcctcccagccgagtccgcggggcctggggcgcccaccccgcccacccaagggaccgcgcaggggtgaactcccccgcgccccacctgcgccttccagacctcgggcgccccggcgttgcctcgagagctccctgcgcggccgccgcggcacggaccagctcccactcccttacactgggcgccgctgcgctcgccgggggccggtcccgaggttcccaaggcctcgcgcgcgcgcttgccgtggcaaccaagacgttccacgacgcgcgctctcgaacgcttcgcgtcac

SEQ ID NO: 209 - DNA, 10000 bp, Homo Sapien
gatacacaataaaatttatttaaaaagactaaaagagagactcaataaaagtatttaacatggcatcgagaacagatttggcattcttaaatgttattaccatggaggtagagaagttgtgcaagtgtgttagaaaccccttcattcaggctggctgcagtggctcacacctgtaatcccagcactttgggaggctgaggcgggtggatcatgaggtcaggagatcgagaccaccctggctaacatggtgaaaccccgtctctactaaaaatacaaaaaaattagctaggcatggtggcgggtgcctgtagtcccagctacttgggaggctgagacaggagaatggtgtgaacccaggaggtggagcttgcagtgagctgaaattgcaccactgcactccagcatgggcaacagagcaagactccatctcagaaaaagaaaaaaaaaaaagaaaccccttcattcaaaaccaggccccttcagctataaccaagtaaattttttgtttatggcaatgtaaattctactgagatgccaaatgtgttatttgacccaattggggctagatggaaattcatgataaacatttgcaaattacaaaagacccctaagcagttactgagatgacaagggtagagttacgtccaggtcactcctttcattatagtaataggttctgtaattctcactaaaaacaatcatgagttctcttgttaatagccccacttatatgtattagtggcgtctgttcagtttccactacctaggtctctcagtcgcaaaaatcatagattccaaaatgaaacatacattctaaagtgaatggtgtaaacttagaaagcttgggagaaaacttaaattctcactgtgactaactgccactaggatttgttctgaagataaactgtcagaaaagcataggaataattttctttgattttgattgtgctgtaaccagcttatcaacacctaggcacctgcgtcaagcattagaagaacttaaagacagactgtagaaatgagaatagtatctttttctcttgtagttcctccagttttgtcaggtagttacaactcaacctacaaggcgtggaaattatcaaaattcagtgatatttttgttggtcgaaaggaaaccaagcaatcaagataattttatacatgaagttttattttttgagctgaatcttaccagataatattctcatctctgtctccatctctatagctgagattcttgggtaagttgtacaaagcttagagaaagttctttcctgtcatcttctcaaattcctgaaacaaattctttggacttgggtaatgtcatcaatgaggacctccagcagacctatttggaatgaataaaagtgggacaaatgcaaagacttaatatcagcagcctgaatcttgttatgcttttatgatttccaggatgtgttctgtcccatttgttgccttctccccaaatgcatactgtgtggcattgacaggctcttagaatatgagggattacaatgttggtaattatagtgattacatttgttgagtgcttactatgtgtcaagctttgctaagtacccttctttcaaaatctcatttcctagtcactgcacttccgcaaggtaatactattacaaaccccattttacaaatgagaaaactgaggcacagagaggttattcatttacccaaggtcatgtaaccagcactgtctcctgttgacaaactattaatgttatttcccatttctcagccttgattactacttaataaatcacctgaaaaataactgcatattttggttcatagtagttcctagtcactcaataggtctaccaaaatatattttttatctttatttcttaccgtcacatggggatcactgacaaatgttgtggatgaaagccatagactgaattgagccattgatgccaggcctcctgccccacacagtggagtatctgctgacataggcctctactagatgctaagttctagaacttagatgtcaccgagccttacaacatgtgcctatgggcacagtagagcctcagtgacctctgtacccatcaggacctacctggcttggcttccatatccttatttttggactcagacaaagaactctgcctctgtgaaaccttccctgtcctctccatgtcttccacagctaaggtgacagcatgtactttgagaagcacattcaggagggctgtctggtataggtgaatcacagggtacttggagggggtgagacaacaccagaaggggaggaaagttattgattagggaaggcgttacatactgttagaggaagtcagtatcttatctagagggaagcactaaaggattttaggctggagaattgacataagcaatatttgaatttaggaaactcattcagcaaagatgcaaggggaacgaggcaagacagtaagcagggagattcattagaaggctattgtaataaagtagaagtcctccaactactacacacagaacctcccagagagctttaaaatacagattgctggggctactccagaatttccaatctagtaggtttggggtggggcctgagaatttgcttttctaaaatgttctcaggggatgcccacattactgatctgggaaccctgctttgagaatgatgagagaactactgttgtaaagaaagaacaattatttgaatcaaggcattgacagtggggatagggatgagaggccacatttaatacatatttaggaggtaaaatgtgacagttttggtgatgggatggagggaagttaggaaggaaaggttttgagctgagtggctgggtgggtaaaggaaccatgcctgagctgagctagggtcccaaggaggatgtattagtccattttcacactgctgatacaggcatacccaagactgggtaatttacaaaagaggtttaatagacttacagttccatgtggctggggaggcctcacaatcatggcggaatgtgaaaggcacatctcacatggtggcagacaagagaagagaacttgtgtagggaaactcccctttataaaaccatcagatctcatgagacttattcactatcacgagaatagcatgtgaaagacccacccctatgattaaattatctcccaccaggtccctcccacaacatgtgggaattatgggagctacaattcaagatgagaatttggtggagacacagcccaaccatatcagaggagagcagaatcctccaaagtgcagtactctcagggttaatgcattttgcttcacctcataatgagggtttcctttaaaagatggatcaatttttccacatcagtaatttctacttttctaagtactatggcaatattttgtgaagacttttcaataatttaagtgttttctgtggacggttttatggtacaaagtaggaaggtgtaagggagagggatcctgggtgacatgaatgaggctgtcagagggcgtgtgtttggggctacatcatgttcttttccctcgcttgtcccctccagtgctgtggttacagctgcaataggaaatacccacaaatgaattctcctgataggcaacaattatgaatattatcattcagcagccagggaagttgtatgccattttcaaaaaggatgaacaataatttttctttgaatgtggcataagggaaatagagcttgaaaagggaactgtaagtgggagaagtcagtcgcagcaggatttccttatgttttctaccaagcaggaaggaaagaaaactgtgttcatcttgactttgagaaaagattataaataaattgcctggtaagctctcaagcaatggattgatcagcagatgcagaagctgctggtattttctgacactgagctctttccacccagtctgtgccactggaggcactactgtgacagcaaattagaaaggatgtgctcctggaaagacactcgttggccaagctggtcataattcatgctctggcaatactgtgcctggaggagggagaatgaaacatttatgaaaatggctcctagcaacacatcacatttgtcaaaaggaaaaaggcaggaaagcaggaatcatctccccaaaagaggccatgctggttttgtttttttttgactagactgcatgtgtgagtttttgaaggtgaacccatgggtgattcatatctgcaactagcttagttgttagtgccttatcatattttaccagaggccaggtgagctttcttgcaaggtaatggggaagaatcggggctcggttattcaataggcagactaagcatgtgtttacggcacttgcaaaactggagcaaaaaattttcttaagggaaggatagtatctaaaaattggaggaaagcatctcaatggtcatcatgtgtagacccagatttttttttattattatactttaagttctgggatatatgtgcaaaacatgcaggtttgttacataggtatgcatgtgccatggtggtttgctgcacctatcaacccatcatctaggttttaagccctgcatgcattaggtatttgtcctaatgctcttccttcccttgcccccccatcccccaacaggccctggtatatgatgttcccctccctgggtccatgtattcttatttagacccagaattttgtgggatttctttatgcccaaacactgttcggcaaatataattaaaaacaaaattttcccgctcaagaaatcttttccacaaaagaagagaaagacaacagttttattactgaaaaagcattaaacccaaatgtgatgtgcatcacaggcaatccctcaagagattgcaaagatagaaagaaatcacacccctttctatagccaagcagatacaacctattccagatgtgttctcaagataaataataactagtcctcaggtaagaagacttgacagcactatttgtcacacatcctttgttctaactttacctggtaattgaggtgaccatctgtgttagctaattggctttatccagaggaaaaacaaacctctcatatctttatgacaggaggtagttttgcaacttggaggattgtgcctgcctaagttaggctcctacccttccacagaaactgggagataggggcactatctcccttgatgtttgcatttcagagaaatggttcccaaggctttgaggaagcctttctgggtcataaagccgacaaaagacctatctaattttggcaaaggtttatatacatttcaaagagaggagaatatgcttacaattttaaggtttctaaagaaaatgctgtaagaaaaaggagaggagggaaatctctttccttatttatttatttatttatttattatttttttttgagacggagtttcgctcttgttgcccaggctggagtgtagtggtgcgatcttggctccctgcaacctccaccttccaggttcaagctattctcctgccttagcctcccgagtggctgggattacaggcacgtgggaccacgcctggctaattttttgtattttttaatagagacgggctttcaccatgttggccaggctggtctcgaactcctgatcttgtgatccacccgccttggcctcccagaatgctgggattataggcatgagccactgcacctggccctccttatttattttaaataaaaaaattgacaggtaaaatcgtatgcattcacaccatgtacagcttgttgtattaaagtatatatacattgtgtaatgactaaatcttgctagttaacatatgtattattacctcacaaagttattattattttttggtgagaacactttaattcattctcttagcatttttcaagcataaaattattattaactatagctaccatgttgcacaataaatttcttaaattgattcctcctatttaactgatcttttcttatttttaagagggagaattaagactcttattttgaaattttaagtgttcttataatatttattttatagttaacattgttttaattttgattcacttgttttttttggggggggtgggtttgtggagcggaggggggataaaatgtactattttcaggaattagtttggcactagaatgagacagggcctggtatctgtccctggctttgaggggcaaactcagagcggggagtagcagtgggatccagggactttagtaatctgtaacacttggttagcactaggaggctgggctgagggagctggagggctcagcatggggtggagttgaaatgagtccagaaaggttttggggataagccccaagtccacccaagcaagcagacttgccattctgtctgtgggtctgaagcccccagtcactggaaggaggcccagagacaggactccagaccttccagtgaaactctaatgagagcaaggcagggtatggtcaatggagggagattaggaactcaaagctcaagatagggatggatgtaactgataactattgcttccactctgtctgccaccgttagtccatcatcaggagcatcaagctttcaatgaattgagttgaaatggcaatttttacgtagtgaattatgggctgccctttgaattactactcatgttttctgattgtagaactatcatatttttagaaaatatcactgtggaaaccaatggctctattaacaacaggaaacaactcaaactggcctaagccagaaggagaattggtttagtaaaaggcagagaggagctatcttcaagaataaacccagggattcagacgatgccatcaaattactatctcccctttccatttctttttatttttaattgacatactaattttatagatttatgggtatgatgtttcaatatgtgtatatattgtgtaatgattaagagcaattagtatattcattacttcaaatatttatcatttctttgtggttgtaacataattcttctagctattttgagatatacaatactttatggttgactctagtcaccttaccgtgcaataggataccaggatgtattcttcctttctaattgtaattttgtacctattaactatcttctccctattcccaccttcccccccatccccagtctctggcaaccactcttctattcactacttctatgagatcaacttttttagattctgcatatgagtgagaacatgtaatatatgtctttctgtgcctggcttatttcacttaatgtcatgacctccaagttcatccatgttgtcacaaatgacaggattgcattcttttttatgggtgaatagtattccatcatgtatatacatcatactttcttcattcattaatctgttgttggactgttaggttgattctatgtcttggctattgtgtatagtgctgcaataaacatgagagtgcagatatctcttcaacatactgattttatatccttcggatattcactcagtagtgggattcctgaatcatatgatagttccatttttgattttttgaggaatttccctactgttttctataatggtcataccaatttacattcaaatcaataaatgtgatacatcacaataacagaaacaaggacaaaggccatatgatcattttaatagatgcagaaaaagcatttaacaaagttcaacatcccttcctggtaaaaacacatagtaccgaaagtcccagcaagagcaattaaacaagagaaagaaataacagacattcaaattggaaagaagaaagtcaaattgtccctgtttgcagaagacacaatcttatatctagaaaaccctaaagtttccaccaaaaaactgttagaactaatgaattcagtaaagttggagaatacaaaatcaatgtacaaaaatcagtagcatttctatatactaatagtgaactatctgaaaagaaaatccagaaaacaatttcatttgcaatagctacgaaaaagatacttaggaataaatatttagccaagggagtaaaaagtctctacactggaactataaatcattgatgaaagaaatgaaagaggacacaaataaatgaaaagatatttcgtattcatggattgggagaattaatattgttaaaatgtccatactacccaaagcagtctatagattcaatgcaatcactatcaaaataccgatgacattctctaaagaaattgaaaaaaaaactaaaattcataaagaaccacagaaggccataaatagtaaaataaaagcaatttctggcaaacaacaacaacaacaacaaaaacaaaaacaaagctggaggcatcacactacctgacttaaaaatctaatacaaagctatagtaacacaaacaacatggtactggcataaaaacagacacatagaccaattgaatggtatacagagcccagaaataaatccacacatttacagacaaccaatttttgacaaaggtattgatggcagcagtggccagtctggagcagctgctgcaaagatgccagctgtggcaggggaggtgtgactggggctgtgtgctgtgtggatccaataggagctgagaacaggcagaagccccacccctgtctaagtaggcattcctgcactcttgggggctcaggaatcttccttgctcctgcaggttggaaatacttgctcctgctgccaggagcccttgctcttggtgcccactctgatttcggagcaatgttgaggccgagcctgggtactgttgccacccagccaagtgtgcatgtgctcggggaagtgctgacacaccaatgccctgttgccttggctccctccagactttgggtgccaaagagcacaggagggaggccaaagtggggccaaagagcacaggagggaggccaaggggaggccaaggagggcagcttggcatgggcctgcaggcacccctcagcatgaacagcctgggtttcatggatggcaggttgatggtggcaggaggcagacaggctcctgagtagaaagaggtgggtccccagtgcagccctatcttcaggcccgggttggcttgaagcctgggggccaggctgccagttccatggacaagagtgagaacttgtggtgctttttctgggcccacccatggcttcctctggaccaatcagcatgtacttcctcccctctgaagccccccaaaaccctagattcagccagatttgggcagatattgggatgacctgtctgcagggtggagctacccactgtgggtctctgctctgctgagagctgagcagacatggggtcgacctccctgaggagaggagctacccactgtgggtcttctctctgctgagagctgagcagatgtagagatgacctgtgtgaggagaggagctacccactgtggttctcctctctgctgagagctgagcagatgtagggatgacctgtgtgaggagaggagctacccactgtgggtcttctctctctgagagctgagcacatgatgggatgacctgcctgcggagacgagctacacaccgagggtctcctctgaactgttctgttgctcaataaagcacctcttcaccttgctcgctctccacttgtccacatacctcattcttccttgacacaggataagaacttggggacccctgaatggtggggttgaaagaactataatacaaacacggctgaaacatgccccttgctcactacattgtgggtgatgagaaggagaggacagaagaagagaagagctgtggcactttggggatctcagacctaggagctcccaagccagagccatgacacccactttgggactccacaattcgtggcatctctaagcatccaggtgccactgcattccctggtgccagctgtggaagctgcttgccatacgcctggtccagccgcagcctcacagggagctggcatccatgctggtgcctggagctgcctgccccaccacagctggcatgcctggctgtgcacagtggctggaccctgtgctcactcactcatgcaccccttaccactctgtgcctgggtcacccttggca

SEQ ID NO: 210 - DNA, 10000 bp, Homo Sapien
caaagcacttctccaaggaaatgtcacatagtcttatctgatcctcaattttgtgaggggtgcaggtttaagtattttctctcagtttacaaatgaagaaacagttctgaatactgatttaacaaagcatattaatcagtagtagacatgagacagtagcacccaggtgttgggaatctaaagaatgatcattctgctgcaatagtacacataaaactcttataaatccctaagaactactacaaattgattacaatcaatacagtagtttcaatttattaagaaaaatataactatgattcagaaacataataatttcccatcattgtcacagcatggatttacagctcttctgcttaatgaattagagattctaaatcagatggaaagcttaacaatcagagaaacaggactgtaactaaaacaaactgtgatagacaacatgatggaagacaaagtatgatttaatacctgataaactgtttttagtaagtaaaaatgcaaaaacacttttttaaaaatttaccttttctacagcaggcacaaactgctttggaatatttgatccgaatgtttcatctgaaaattccaatttagtgtagtcctctgggtccagaggctccaggacacctattacttttccatactggcctgcaccacctgattgttttttatgtgtaaagtcaaacctgaaagtgatttaggaaaaaaaaaatggagcattatgtaattacaaaataaaataactcctattaatttaaaagaacacatttgattatttttactttttcatttgaatatgatggtcttgctataaaagtttattgtagaatttattttaaaaagaaccctctgttttctgttcttacttgaagtgagggtggggtatactacccaaggtaatatacagataaatttcacaaataaaaaagtaaaagtcgagtaattaaaagaaaaaggtcagtctaaggttcttgttctaataacctgtattccaaaaaccttgcccatttccctggaacacagtgttctttccttacatctctgtaaccaaagacaactacttgaaaataggacctttgatggctacagttaatttattcagatagttcctatttgattttattccttgggcattatagactcaggcaatacaagaaaagggatttccaagtgaaataattaatatctgaaaatgatcggtggcaaaacgatagagactaacataagtaagtcattcaaaagacacagaaagatgtataaacacagttcactgtttacttcaaaccactaatggcaacattaatatgatagaataagcactttacatatatactaaagatatgtaaacacaggctactgtttcactggaaaatcatttcatgagtatctactgtttgcaaggcatttcttcctttaaattgaaatcttcctcaagaccacaagatggaagaggccagctgctttcaaaattattagcacataagaaaatagacattaatgactgcacattcctgcatacaaatctgagagtggtttggaagaagcaaatatcaatatttgcctgttctaagctggtaggagatgctagcttacaacaggcaaatttccaaaactgtggaacgctgacatattctcaagtatacacaacgttctctatgagacattttaaatcatgttttccatttgtcaacagtataacatctatacaaacatactctagatctgtgatgtctatatggtaataactaaccatggctgtttacatttaaattaaaagatttccatcactgcaccaagttctattgggcagcactgctctaaaggaccaaatcgcaaacaagtaattccacacagtttcaggaaccatatctgaatttataatcgagagcgtgccaaacaacagaatacttatgtgccaggcttatgttaagcaccttatatggattgtcttacttgttctttaccacaaacccatgaaataggtattacttttatcaccattttacacatgagaaacctgagggacagagagactaagtaacttgcccaatgtgacagagcattaagtggtagggtcaggatttgctctaaaaccaagcatcttaaacattcttctagaaggctaatacaaaaaagatataaactaacttacaaatgctggggttagtttattcacttcaaaagctaaccgaaggtgctacaagaagacagattttgcagtggtttagaaaaagaacaggtagaagaactaagactgcttgacaggcagctaaatagaaatgctgaaggtgaaagaaatgtcacattatgaaagacaatttcattttggcaaaacatctgtcacattaaaatgaacgttcattagaattgttgggtggggagaggttgagggatgagaactcacctattgggtacaatgaatactatttggcagacgattacactaaaagcccagacttcaccactacccaatatatccatataacaaaactacacctgtacccactaaatctattttttttaattgaaaaagaaaaattatgtcagggccacattgttttcaacaacgaaaaatatatatacatatatgtaagaattgtgttggctttgctgtttacctcaaatttgcagatttgttttgactttagagtcataacaaagttgcaagcaatgggcatttctactaattatgtttttaagacagcctaaattggtatgtgtacttttaaatgcctattatctcataacctatgttactagctttgatatacagagatggtgactgcattcataaggcttcaaaatggtgacttgaggaagctcacatattgtatttctcactactggtggtaacacaggagatattaactagcaatttgtgaaactcaaaatttcattatcagcaaaaagctctgagttatcagaatgtactcagccactttcctggacactatcaacagaggacctattcaaaaaaactcacatgcacaacgacaacctaagaggctggctcacagataaatgactcatcaaaaggaaaaaaaaatttagagaaaaaaattcctccaacttcttagaaaaagccttaagaggagaactaaccatttcatcctttagttgctttatagttgctggctaatataactagaaaagatgagaaatgctgtattgctattaatttttttaaaagctacttagtccaaagaaacactgtatttataaataaattaaaacagtttgaggaagatagtacattacaaatacatttttgttcattttctttttcaaagcatcaaaacatacaggcatatcttggaggcattgtgggttcagtaacagaccactgcaatgaagctaatatcgcaataaagcaagtcacacaaattgttttcctagtgcttataaaagctatatgtttacacgatactgtagtctattaagtatgcaatagcattatgtctaaacaaaaatcccaccatacataccttaatttaaaaatactgtattgctaaaacatgctaacaatcagctgaaacatcagcatcagaactagaagtggagactgaaggtctaggagcctagagggtcttagcttgatgctgatagctactgactgatcaaggtgatggctgctgcaggttgaggtggctgtggcaatttcttttaaaatgttttttagagatgggtctcactatgttgcccagggctggtctcaaaatcctggtctcaagtgatcttcctgcctcagactcccaagtagctggaattaaaggtgtgaaccacttcacccagtcacatgacaatttcttaagacaacaatgaagttggccacatcgattgactttccctttcacaagacttctctgttgtatgtgacgctgtttgatagcattatatccatagtagaacttctttcaaaactggagtcaatcctttcaaaccttgccactgctttatcaaccaggttttaccctttgttgtaataacaatgtttgcagcgttttcaacaggagtagatcccatctcaagaaactactttctttgcttatccatagaagaaggatctcctcatctgttcaagtttgaacatgaaattgtaggacttcagtcacatcttcaggttccacttctaattctcctgctattgccaatacattcactgttacttcacccactgaagtcttaaactcctcagagtcatccatgagggttggaatcaacttcttccaaactcctggtaatgttattttgacctcctcccaggaatcacaaatgttcttaatggcatctagaatggtgaagcctttctagaaggttttcaatttacttcgtccagatccatcagaggaatcaacctatggcagcgatcgccttacaaaatgtatttcttaaataataagacttgaaagtcaaaattactctttgatccagggattgcagaatgaatgttgtattggcgggcatggaaacaacattaatctctttgtacatctccatcagagctcttgtgtgacaggttaattgtcaatgagcagtaatcttttgaaagaatcatttttttctaagcaatggattttaaacattcagtaagccatgctgtaaacagacatgctgtcatccaggctttgttattccatttgcagaatacaagcagagtagatttagcataattattatgggccctaggattttgacaatgagaaaggggcactgtcttcaaacttagtcaccagctgcattagcccctaacaagagagtcacagcctgtcttttgaagatttgaagccaggcactgacttctctccagctatgaaagtcacagatggcatcttcttccaaaagaaggatgtttcatctacactgaaaatctctgttgtttggccaggcatggtggctcatgcctgtaatcccagcactttgggaggccgaggcaggtggatcacgaggtcaggagtttgagaccagcttgaccgacatgtgaaactctgtttctactaaaaatacaaaacttagtcgggcatggtggcagatgcctgtaatcccagctacctgggaggctgaggcaggaaaactgcttgaacccaggaagcagaggctcactgtagtgagccgagatcgtgccactgcactccagcctggacgacagagtgaaactccatttcaaaaaaaaagaaaaaagaaaatctgttgttctgtgtagccaacatcatcaacgatcttaggagaccactgatcattgctgcagcttccacatcagcacttgctgcttcacctttcacttttacgttagaaatggcttctttccttaaacctcatgaaccaacatctgctagcttcaaacttttcttctgcaactttctcacctctctcagccttcataaaattgaacagagttagagccttcctctggattaagctttgacagagagagagagaatgtgcaagcacaactggtaggtagagcagtcaaaacatatacaattatatggatgaagtttgctatcttatatgggcaggtttcatggtacctcaaaataaattacaataacatcagaaatcaccaatcacagatcaccataacagatataataataatgaaaaagtttgaaatattacaagaattaccaaaatgtgacacagagatgtgaagttagaatatgctattagaaaaatggaggtgaggccgggcgtggcggctcatgcctgtaatcccagcactttgggaagccgaggcgggtggatcacttgaggtcaggagttcgagaccagcctggccaatacggtgaaaccctgtctctactaaaaatacaaaaattagccgggcatggtggcgggcacctgtaatcctagctactcgggaagctgaggcaggagaattgcttgaacctgggaggcggaggttgcagttagctgagattgcaccactgcactccagcctgggtgataagagtgagactctgtctcaaaaaaaaaaaaaaagaaaaagaaaaatggagctgatagacttgttccacatggggttatcacaaaccctcaatttgtaaaaaacatactatctgtgaaacacaataaagttgaataaaatgaggtatgtctgtttaaaaatggaaaatataattaaggtttttaattttaaatttcatatttaatgtaatattctgacaactcactttatcagtatattaaataaaacagtatatatatcacattgaaattaccattctaacaaactaataaaattcatatcttgtgtgtacatatatatttattttcatgtttttctgtagttattataccaagtatattcttattcttattaatcaccacttttaaccaaagtaatcaacttttgctttcccaaagagaaaaccagaagacagaaaaccaagaaatgtcaagctaaaatttttttttgagacagggtctggttctttcatccaagctagagtgcactggtgcaatctcggctcatcgcaacctcctccctgtgctcaagtgagccacccacctcagcctcccgagtagctggaactacaggcacatgctatcacatctggctaatttgtgtagtttacagacagggcttcgccatgttgctcagactagtctcaacctcctgggcccaagcgatcttcccacctcagcctcacaaagtgctaggattacaggtgtgagccactgcacctggttagctaaatttttataaatacaaattttagattacttctataattttaaggtggcaaaacaacacatatataacaaccaaagtatctgcacattgtgttaattcataatcattttataatgtataagaataaaggtaaactgaaactctctttagtaaccaaagctctgtatcatgtattagtcagaaattgtccaattatcccaggactaattgaacattatgtaagggcctgaaagttaactggagatctgaaaaattataattttagttaacacatttggtctttataatagaagcataattttataagattaaaactcctttaaaagacatctgtattaaaattttatttaaacaccattttatattttgtaatcttatacaactgattgaatcagtaacttgtttggcccatttgatcaatatataaaatttagaaagtttagatcatgaaaagatcaaattcagttttatatgaacttggaatattttatcattatgtaataaaacctggaagacatataatcaactttaaataaatattattttgttacagctcacccaaattcatctattaatcagaaatattttatacatttttaaaaatataatttataaactttatattcaaaaatcattaaatcatgtttaagagctcctcttttatcttgaaaacttgtttttttttttttttttttttttttgagatggagtctcactctgtcacccaggctggagtgcagtggcatgatctccactcactgcaacctccgcctcctgggttcaagcagttccctgcctcagcctcccgagtagctgggattacaggcgcccgccgccacgcccggctaatttttgtattttaagtagagacggggtttcaccatattggccaggctggtcttgaactcttgacctcgtgacccacctgcgttggcctcccaaagtgctgggattacaggcgtgagccactgcgcccggccgtaaacttgctccttataaacataataataaaggctatttaagttcatttgaccacattaatttttacacattttttaaagcacaatgatttttttcttagacatttttggctgtttatttggactagatattcctggactgcacatataatgacagaatgacttagtctcatgaatcatctttcaaatttttaatgaaagaaaatgagaaacaggaaaaggtgagctacagccagttttagacaaatatgaaattatcactgtaaaacgctaattatcttttcttttcaaggagagaggaaaaagcttaaatataagccatgttattaataaaaaaccttgaagtatggaaataaaatatgggcagtcttctacttaaaatgctcttagacaaataagacaaatactgttctccgaaagtcttatttttttatttctggtgttcttctaaagtgtctctcaaatgaacagtcttcttcatgtcaaagttccccaaatttcaccaattctttggtaaatttatcccaggagacagtgtaagttcgtatctgacaaccccatcgaaaattggctgatattctgtatttgcaaaaatattgccatgggtgggtcagggtttaacaaatgctgaactaagaaacgtggagaggccaggcacggtggctcatgcctgtaatcctaacactttgggaggcagaggagggaggattgcctgaactcaacatggtgaaaccccatctctactaaaatacaaaaaaattagccaggtgtggtgaagtgcacctgtagtcccagatactagggaggctgaggcaggagaaatgcttgaacctgggaggtggaggttgcagtgagccgagatcacgccactgcactgcagcctaggcaacagagcgaaactctgtctccaaaaaaaaaaaaaaaaaggtcatgtgtgaaagacagtgtctcgcaaagcaaatttctcatacacggacaagactgagaaaagtttcattgacatttgatacaagatgatgggcaagcagacagatggtatttaaaggcaaagtcaatcagaacccccaaatcccaggagacaataataagcatgaaactgaggccaaagtccagaatccagatttactgcagaatctacataatcagaaagagatacacctcaagagtcttgggtgtgtgcattactaccaagttaaaggtcctggccaggcatggtggcttatgcctgtaatcccagcactttgggaggctaaggtgggtggatcacctgaggtcaggagtttgagaccagcctagcctaaacccgtctctactaaaaatacaaaaaactagccgggcattgtggtgggcacctgtaatcccagctactctggaggctgaggcaggagaactgcttgaacccaggaggcggacgttgcagtgagccgagatagcaccattgcactccagcctaggcaacaagagtgaaattccatctcaaaaaaaaaaaaaaaaaaaagaaaagaaaagaaaaaaaggtctcaatccaggcagcgaagaccttggccaaactttggtagaatctccaagttatcctagcccaattaacctaagaccaccaaggataaacctgtacttctacaaagtcaggtttataggcccattgcaatgaggtagaccacataccagagagagtgctttgtataagttcagtttttaagtttattttaatccttgaagtaaaatattcaaaatgactcaagttggaagcatggcgttacatcaaaacttatcattttaagattagtaaaggagaggggtacaggtgcatttttttatttctcctgatccaaattacataatctcccaatttaatactatagtttgcagattctcatactttgatttgggcagaactggtccaaacccacaaaaagctgaggatgagcaagcctcttcctggactctcataaggggaagggaaatgaaggaatcgaatcactacctggagtactgtgtaccttgccctgccagggacgctgcatgcggtgtataaggaagttgtgctccagtatgcaagcgaagcaaccagacttttttcccatggacaggaaactagagtcttcagagatgtcctatatcagcgaaagccccaccctgcacttctataaaggttaatgaaacgaaagatgcaatcccagcgaacctagcccactgactccctccccacacctccacctgctggtgcctgacaagcatgctggcctctcctccagtaggaaccagcaggcggagtaaggaagcccgctgcaggcagtagtggggcggggcctcagaagcagtc

SEQ ID NO: 211 - DNA, 10000 bp, Homo Sapien
actcatgccacctttacatatttcttagaaaggaggatatataatggaggaagacaaggctcaccgatgagttcaaaacaaggggacgaagaaagtgaggaattaaggtttgctcctaagtattttgcttgagtcaagagactttttttttgaaagatatatttaacattttacattatgtatataatagtcaaaaagtcttttatctcagtcaatgaatattttatttcagtgaaagggtcttatatatcggggacatctggcctgggatctaggaaacatggaaggaaattaatctgtaataaagtgttagtaattaagaggtcaagctctatgactcagtctccaaagtcaactttcctcaagtcctaataacttttagacgcccccaatatacagactattttcttttaggctcaactttctttacataagacatgtgaatccacacgtctatgccttctacattttagtgcaaggattagtaaaaagtaactaatagagcgctttccagtttggttaaagggagtcctttaaccaaatatcattttagatatcatttccagtagaaaaaaatctcctggctgaagttcatgggttttaagttctttgtttcctgggagttcactataaaaagagtcttttttcaaattatgatttttaggtagttgttttataaagatgtcagaaaaatttaatatgtcttcttttagcattatggatttatactttcctggggatagtttcatgcatctacctgttattatctcaattagggaaaactgatgtctaccaaaaggggtggattttaggttaaggaaaaccagtggaagggcccttggccaagacatgtgaaaagcctgggttaattttgccaattgaattttaattattttgtttatgcattctactaatgcagatgactgagggggatatgcagaatggaagtgttaaagaattggccatattttacgtagtgactgaattacatgggcagtgaaatgagtacctctgcccctatgaagttctagagagactcctcaagtctaaataatttttcaaggagaattttacttaatgttagggctgttgctcttctgcatggaaatgcttctacccaatgaaactatacagactttcattactagaacatacttgtatccttgtgatggggtagtcgaataaaatctgccacacctcaaagggggcctcaggtaaagaaaaatgttcttaggaactatgtaaaggtttccctggattatattttgggcaaatatggcagcaactaaatgctttatgagctatagttgaagaaacttttcaaaatactatttttctcaataaccactttatcagggctccggtgaattaaatcagtccgtagggttgaaaatgatgattgtaattcagtaggaagtataggcaagttgtttagtccacaccatatttcacctttttgttttatattttctaattctgtttttagagctctggattgggttaatttatgtcaaatttgggggcttctttcaaagttaatatgaattgtttttattgcctagatgtatttaggcagtcctcattgtaaccttatgagctagctgacttccttcactttctggagtatctgatttggaattttttggagtatctgatttggattttaataataggtagtgagttttataataatgtttttttaataataaagagataaggtatccattttttatggactggccggaagaggttcaagaccctctttatttattttcacagtattacaaagtcacgaatgacttcaaaggtatatctgttgcctgtatataaattagcagttgttcattttgccaactgacaagctctaattagtgctgtcaatttggcttgttcagcagagattgcttctagaagataagcactttctattttttcccttgggatattataacataacctgcttgtaaatttgagattaatctttaagtaagatctgtctgtaaatcaaaccacaccagtgttactaagatgagtttcttgcaggtttgtcctaggagagaaaagctgaccagttaaggttatgcaatcatgaggcatttcatccaaatttagggggagaagagtagcagaatttaggttattacatgtagacattgtcatatgaggtccagaaagaagtaagacttctaaagggactagcttgctaactaagtaattctgagcatgaagtgaatttagaagtgcttccaggctggcatgctggctcatgcctgtaattctagcactttgggaggccaaggtgggtagattccttgaactcagaagttcaagaccagcctgggcaacatggtgaaaccccatctctacttaaaatacaaaaattagtcaggggtggtggcaggcacctatagtccctgctactcagaggctgaggtgggaggatggcttgagcccaggaggcggaggttgcagtgagccaaaatcacaccactgcagtccagcctgggcaatagagccagaccctgtctcaaaaaaaaaaaaaaaaaaaaagattatgcaatcacgaggcatttcattcaaatttaggggcagtttcatatgaggtgaagaaagaagtaggacttctaaagggaccagcctgctaactaaatatttctgagtatggagtgaatttagaagtgcttccaggctgggtgtggttgcttatgcctataatcctagcacattgcgaggctgaggcaagaggctctcttgagctcgggaatttgagaccagcctgggaaacataaggagacacccctgcctccagaaaaaaaatttaaaacttagccaggcatgttggcatgcacctgaagtcccacctaggtaggaggctgaggtgggaagattgcttgagcccaggaggtttaccagtagggtgattgctgtattaaccccatgcaggctggtagtcctctagccactgaatccaactgctgactgttgtattatataggtctcttttgagccccatgtttttgggtcataatgcctagggtattttcttgatcttcctgtacaaacaacgtaaacaaaataatttggatttcctagtactggggcatctataagatcctttaaattgttcctaacattaattgatttttctctgtccaatccagagagtctgcttgtctcattttaaaagggtatagaaaggtaagcttttaatgaaaaattcagaatctaatttctgcaataattttccagttccagaaatcctcttaggtgttttcttagtttttagggtaagcaaggaaaatatttgttttattctatttgcatcaataaaaaggcttttcttggacaatagataactctaaatattttactcattgtagacagaactcaagattttttattggagaccccatgtctctttgaaagcaatttttgtaacaagtgaatcccatctttttgtagcagctttctcatcttctgaacaaagaaggaaatcatccacatattgtattaaagtatagttttcaaaaatgcagcatataagacatttggtttcaatatttctgagaaataagttggactctgagtatattcctgaggcacaatcatccatgtccattgtttgtctttccatgtgaagccagtagtgtgggggaaagcaagagagatcagactattactatatctatgtagaaagaaaaagacgtaacaaactccattttattccgtactaagaaaaattcttctgccttgagatgctgttaatctgtaaccctagccccaaccttgtgcttgcagagacatgtgctgtgttgactcaaggtttaatggatttagggctgtgcaggacgtgctttgttaaaaatgtgtttgaaggtagtatgcttggtaaaagtcatcgccattctccagtctcaagtacccagggacacaatgcattgcagaaggccacagggacctctgccctagaaagcctgggtattgtccaaggtttctctccactgagacagcctgagatatggcctcatgggaagggaaagacctggccatcccccagcctgacacccataaagggtctgggctgaggaggattcgtgaaagaggaagatctctttgcagttgagataagaggaaggcatctgtctcctgctcatccctgggaatggaatatctcagtgtaaaacttgatcatacattctatttactgagataggagaaaactgccttatggctggaggtgagatatgctgggggcaatactgctctttactgcactgagatgcttgtgtaaagtcaaacataaatctggcctacgtgcacatcaaggcacacacagcacctttccttaaacttatttatgacacagagtcctttgctcacgtgttttcctgctgaccctctccccaccattaccctatagtcctgccacatccccctcaccgagattgtaaagatagtgatcaataaatactgaagaaactcagagaccagtgctggcgtgggtcctccatacgctgagtgctggtcctctgggcccactgttctttctctatactttgtctctgtgtcttatttcttttctcagtctctcatcctacctgacgagaaacacccacaggtgtggaggggctggcccccttcagctgtacacaagcaaacaccagattctccattctcaggttccattactctatgctgtacatttgattcttattccgccccttctgaggtatcttgtggtcttatacgctaccaggaatttgcaagtactttcccttcttgtgaagtgtttggcacacaggaaaacatgagggaatattagttactatacttgtcctttcatgaatcatttgaaatgtcacttcttcagacagcattctgggatgcctctcagttttgtcttatttataataatgcaatcattaaatataaaattgcaactcttaagtggggctaaggaagggaactatagaaggcattcaatagggaaatagaggaagcatctctcttccgggaataattgaagatcatttttcctgatcatcatcatctgctcacttaactgctgttcagaatggactgtgagttccacaaaggcagaagtctataatttatttttagccccagtgctcagaacaaaaactggaacacagcacttcaataataagactattgaacaaataaccatatttggctgacaggctacagtctttccttcttcacttaccctcaaggtgctgtgctgctgctcagtgataattaaacatagaaaagatgcagctgggcgcggtgcctcacacctgtagtcccagcactttgggaggccgaggcggtgtatcacgaggtcaggagatagagaccatcctggccaacatggtgaaaccccatctctatgaaaaatacaaaatagttggctgtggtggcacgtgcctgtagtcccagctactcaggagtctgaggcaggagaatcacttgaacctgggaggcggaggttgcagtgagctgagatcgcaccactgcactccagcctggcaacagagcaagactccgtcacaaacaaaacatagaaaagatgcaaaagagtgtatgctgtatgccaccttttgaaaaaaggacaaataaataatatatacttgtattataaaaagaaacactggacggattcacagtaaacatgtttacctgtaaaagctagaaggtcaggggaaaactaggattgagaacaggataagatattcacaaatgtgcttttttgtacagctttaagttttgaatcgcatgactatgtgacctagtcaaactatttcagagtaaaaataaacagccagtagagtctctatcgccctaggagtggaggctgatcacagggtaatctaaggatgagatcataaaataaaacaaaccctccaagcaaaaaaaaaaaaaaaaagttttagatgccagaaaacatttgaatctacagcctgccacttggcagctaagtagcttgaaagctgttggagcaacactccttaattcaaccaaatactgtctcagcatctgcgaggtgcctgatctagtgcccaatgttggaggtgaaatgatgaggaaaaaacagacctgctctcttgaagggggccagcccttccacccctgtggatatttctcatcaggtgggatgagagactgagaaaagaaagaagacacagagacaaagtatagagaaagaacagtgggcccaggggaccggcgctcagcatacagaggacccacaccagcactggtctctgagttccctcagtatttattgatcactatctctaccatctcggtgagggggatatggcaggactatagggtgatggtggggagagggtcagcaggaaaacatgtgagcaaaggactctgtgtcataaataagtttaaggaaaggtgctgtgtgtgccttgttgtgcacataggccagatttatgtttgactttacacaaacatctcagtgcagtaaagatcagtattgcccccagcatgtctcacctccggccataaggcggttttctcctatctcagtaaacaaaatttacgattgggttttacactgagacattccattcccaaggacgagcaggagacagatggcttcctcttatctcaactgcaaagaggccttcctgttttactaatcctccagggcccaaaccctttatgggtgtcgggctgggggagggtcaagtctttcccttcccaagaggccatatctcaggctgtctcagtggggagaaaccttggacaatacccaggctttctagggcagaggtccctgtggccttccgcagtgcattgtgtccctgggtactcgagactggggaatggtgatgacttttaccaagcatactgcctgcaaacacattttaacaaagcacatcctgcacagccctaaatccattaaaccttgagtcaacacagcacatgtttctgtgagcacaaggttggggctagggttacagattaacagcatctcaaggcagaagaatttcttagtacagaacaaaatggagttccttatgtctactttcttcatagacacagtaacagtctgatctctctttcttttccccacactctctgccttcaggaagtttagaatccagatggggaatgcacatggaaatctacaaaatgttaaactgcagttcccctaagtgctaggaagaagaggaacacgatcctatggaaggccagactggtgagggaaagttgctctgaattagtgatgtttgaagatcctgaaggaggaaaaatgcagaaaatggggggaaagaaaagttcaggcagaagaaagagcatgcacagaggcctgaaggtgatgaaaggatgtcagcagcatatgaggggccaaaagagggccagtgtgtcagaacagggagagcaaggtggagtatgggagagggaagaaagaaccggaacatgcagacttgatggccattttaaggatgtttgccattgtccagaccccaagcagaacagtcattgcaagtttcaaagtttaaagctagagagtttcataatcacagctctattaagcttaaaaagtatgctatatgaggaatccttggctcagtgcgtggcaacctttttgtcatcaagtcacagttttgattaagttcaggcacacctatactcttgattcctcctcttcccctcactgggactaataacattacttgtattaattgtgtttcttgctagacactgttttaaggactttacatttacttctcacaacaaacctgaggcagatattttaaagctaaagtcaagaccttggtaaattagttgctctatggcacatggcttgggcatggcagggcaggattcaaactaagcagtgtgacttcaggatacattccaaatcactatgcaggactgcctcttggcccaggagggactgaggtcatgggagcagatgaagggtgatcttcagtgaaactataaggatcttgggtttgggagcagacatgatgtgtaccaagcttaggtatgcactgagcctccttcatctgggaggtcaagctctgaaaggtacgttaagcaattgctcagggtaggcctggccaactcatccttagaccctgatagagcataagcaacctgaccttaccatggaaggatgtgcagattcacaaaggccagatgtggatagggcctggttggtggagcgcccatttctgattctttgctggagagtatctgctctgaatctatcccattataatgtgggggtaatgatggggcactaatccaggatttagggcaaagatgcacaaaattaggtgtgcaccagaaagccctcattacaaatgcagagtgccaggttccagccccagaggatctggtttaggaagtctaggggtgactcagggatttgcatctttttaaatttctgagagacttgcggcaagaagctcacagacaattacaaatactcctggagtattctgtgcttacaaatgctgtaacaggctctcctcagtacacttaggtcttggctcaaattacatccagaaaagccttcccttggagaaaaaaaataacatatttttaaaagcccccatcactacgtatgcattagtatccactactagtctttttctccttcctaacatcgtacaatctgtttctctgcctcactcaatggtaaagtttataaaggttattcctttgcctgtattgttcaccgatccatcctactgtatctaaaacagtgccttgcacagtgatgatatataaaagttacttagtggccaggcgcagtggctcatgcctgtaatcccagcatttgggaggccgaagtgggtgaatcacgaggtcaggagtttgagaccagcctggcaaacatggtgaaagtccatctctactacaaatacaaaaaattagctgggcgtggtggcaggcacctgtaatcccagctactcgggaggctaaggcaggagaatcgcttgatcccgggaggcaaagtttgcagtgagctgagttcgtgccactgcattccatcctgggcgacagagcaaggctccatctcaaaaaaaaggttacctagtaacccaggatttctgttgaattctgacctagccacaaggcaaatttccatttattttcctatgagcagcacttactgtaacttggacagtgtatccatatgggatgaaggttaaaaaaccagataaagaaggccaagagacctactcccagaaaagtgagaatgatgaagataaatcatgtctcaaaaaaaaaaaaaagaaaagaaaaatcacatctcagttcagcaggtcacagagaagctgggatctctgaaatggtaaccctagcgggtgataggtcttatggacaaataaaagcgtcatctctaagacgtcccaaaagaaacccacctcctcccatctgttacagtctcatccattctcagagactaagattttcctcctcctttgtgttctacttattctaagagtccttttccttttctgctctgccccttttatatttggctaagtctttctaatcacacaaaagttgtgagtgacaattctattctttacaactgtcattcccttcaatgacaaaatacgcttctctttccaaatcattctctctccaaatcaatacataattagtttttgtttttctatgtgttgggaaatattagatcatgcaaagcagcctctccagcataactttctgggatgttggaaataatgacaaagagtcctcattgtctgaaagttctgttcactctgctgtccagtttagtagcctctactcacatatacagctcttgagcagtgagggaactgaatttttaaattttgtgttcagtttctttaattctaaaatttaagtagctacaaaacttagcagggaatttgtaatctcttggagagataagacacgggcaaaaacaaacaaacaaaaagccctcctttttgtactaaggtgcttaagtaccattaacagcagtccttct

SEQ ID NO: 212 - DNA, 10000 bp, Homo Sapien
aagtgaaagagaactgtgaaatatagaggggccaggaattgctgggtttgaaaataaaagtttctcctttctagcttcttcatacggcaaatgaaatggcttcccggtgaagattgaacccaggaggcagaggttgcagtgtggtgagattgtgccactgcactccagcttgggcgacagagcaagacttcgtctccaaaaaaaaaaaaaaaaaatttggaaagaacttagaggggacggtttatctctgctcaactcagtgtcagcgggggtggttcaaagattgggggctagaataaactcaaaactcactcattcacgtgtccggttggctgatgttggctgttagctgggagctcatgcagaactgctgtccaaatatcaacacgtgacttttccatgttgatcgggtttggctctttgtccccatccaaacctcatgtcaaattgtaatccctatgtgtggagggagggacctgtaatccccatatgttgagggagggaggtgattggctcatggggttggtttccccccatgctgttctcatgatagtgagtgagttctcatgagatctgatggttttataaggggcttttctccactttgcttggcacttctctctcctgctgccatgtgaggaaggacgcgtttgcttccccttctgccatgattgcaagtttcctgaggcctccccagtcatgtgaattgtgagtcaattaaaactctttcctttataaattacccactctcaaatatttatttatagcatgtgaaaatggattaatacacatgtagtgtttgatttccccatcaaatgacaaggtggttgggttcccagagcaagcactgcacacgagagagagagagagagagagagagagagagacagcgagctaggaaacctagtccctgaagtcgcatagtattgtctgctgccttcctgttttgtttgtttgttttagagatggggtcttgctctgttgcataggctagagtgcaagtggcagatcatagctcagtgcagtcttgaattcctgggctcaagcgatcttcccacctaagcctcctgagtagctgggactacaggtgtgtgccaccatgcctggttaatttttattttattagtagagatggggtcttgctatgttggccaagcttgtcttgaactcctggcttcaaacttggcctcccaaagcgctgggattacagacacgagccactgcaccagtcttgtcttcgattctttacaagtgagtcactaagcctggcccatgtttaaggagaggagaatagggttctatcttttgatgggaaagagtgtcaaagaatttgaggacctgttttaaaaccaccaatattaaggtatccttagctccattttatagatgcataagctataattcagagaacttgctgaagttctcacaattagtaagggataaagcttgggaccataaagtgactgtactttacatacttaaatacattatatataatgtacaatctgtaaggcaatgtaaagctatgacatgttattaattgtctcagttgagctttcctagcttcttgacacaaggaagggagcccatcaggcatgtgggttatgaatcaagaagctttattattttttgtataataaaatatgagtttgttttgttcataagtgttctcttatcagatcaaactctcataatggctggaaacaccttctgtcctgatttcagagcatataactaggttctatattcctatcaaccctctatctaacttaacatacaacatacctttaccttgctagccctatgtttggctaagacagctgagctgaggggagctctttgacattgcataatatggagctctttggtctctcacaaagaaaaaatgtgctcaccaacttttgctcaaaggtatttttggctttatagttaaatttctggttaatgatcagttttgctaattgaatacctcacatttcttttggttagatggcatttatctgtatctgtgtgtatatgtgttcaaatgtgagtgcatatcctcatgggagcatgtttccaaatagtttgctttctaattgtttgttactaacagccctttgaattttcttaatgagcactttgttgtacaatgaggaaaaacaattaactgcacaaaatttttgtgcgatcacaaaagacaatcaaattatgatatatcaaaaacaaaatagagcaaaccattgtgcttagcaatgtatggaaatatcttctgagaagcaaacaaataacttttccggacactatggtgttttttatgatcatgtttagtttatgtcatctttttcatggaacaaaaaccagtctctatggcttttggcccatagtccccatatcttttaaaacctgtgaccttaaccactgtgtacagtattagatcttcaaaggtgttttgctcaacctctccttctcttgcaataatagcaaacacataaacactagtacggattattgttgctagaaaagaataatgaattgtacattgtggtaaataaggtatttaaaacaccatgtttgggaatttaccaccgtgatctgtaatttctcttattgctttttgctcagggtttcatccctcctccctgccctccaagctaatctgggccaagtggattctgttctgacccatctctaactctttactcagtctattccttaccctattttgcctttttttcttttctttttttttttttttttgacatagagtttcactctgttgcccaggcttaagtgcagtggcacaatatcagctcacagcaaccttcgcttcctgcctcccgggtttaagcgattctcctgcctcagcttacggagtaggtgaaattaaaggtgtgtgccaccacacctggctaattttttgtatttttaatagagactgggttttgttatgttggccaggctggtcttgaactcctggcctcaagtggtcggcccgcctcagcctcccaaagtgctgggattatatctgtgagccactgtgtctggtcccatttttgcctcttttgtcacttttacaaagcctactaactgtctctcttttttggagccctcgatacctagattacaaaggtttattccagttgtaagccatgagaattgtaggtaattctgtgctgaaggatggaaatggtgtatgaattaaactggctgcaatagtctataaaataacagattcatagctttcagcatgagccccaggcagtgcctaggagcagtgcacacaagacatcctcaatcactaattggtgagtgaatataaaaggacctgttttttgtagcagatggagagattaagcggcttgcccaagattacacccgtggaccatgatagagttcctacaagaatccagatttttctgctttgtccagttcttacaagtatatactgcccagcttccagtgattgcatgaccttcggaagacttgtaaatgtttatgtctctgcgatctggagattaacaatgctgcaaagcaaatagtccctcaggccattccggtatctgaccaagttaggatcttggcaaatgctttagttcctctttcctggtgttaggaaaacatttatttcaattataaatatattatcttcaatttcttgataaattagactaagcaaacatttggatgatgtcaatgaggcagacgggattccgataatacatgtttttcttagtacaaaagtgatacttaattatagaaaatacagagaaaacaaaaagaagaaaatgaaaaatgcccattatcctaccatgtctcaaagataaccattttttaacattattttattttattttactttattttttgagacagagtcttgctctgtcacccagggtggagtgcagtggtgcgatctcggctcactgcaagctctgcctcccaggttcaagtgattctcctgcctcagcctcccaagtagctgggattacaggcccgcaccaccacatctgtctttttttttttcctttgtacttttagtagagacagggtttcaccatgttggccaggctggtctctgaccttaggtgatccacccaccgtggcctcccaaagtgctgggatgacaggcatgagccaccacaccaggccaaagataaccattattaactaattaactatttggtatattatgcctccagttatttgaaagtgtatgcacattcacatttacaaactcttttatattcaatttctttcacttaatattttatgaacatattttcatattgctaattattcacttgaacaatataatttttgatgacatagtttttgtatagtgtaactttgtatttggccattctttattagacattgtttccaaatacaagaaatctttaagatgatttgccacacagatacaatcactacagtggtgattctcagtctctacttgcactccattcgcaatccagtgctctgttaaatgagacagagacagagagagagagagagagagagagtgagaggttgagagagagagaatggaggaaggctaggcaaggagaggcctgaatcctaatcatcactccacacttttccacacccttgagttttatttgcacttttgcttgctcttggggtgaattagctcacacttaaggctgtcactgctcctcttgcctcacacccttttacttccttcatttgagtgttccaggtgagttcactgggccagaacctcctacaatctgctcaagacctagaggtttgaatggggaatgtgagcgctgatagagacagggagccaggtcgtgggttggggagggcaaggatgcttcctgccctcctccttcatcactagtggctactctagggcctgcctgtgtgtgccagggctgagctagggcctggccccctggagttctacagagtccctctggtacctgagccacaagagaggcacctgttcaggaaatctcatcagaatctaaactttaagaggaatctcagaacttatccatttcaacattcacccaatgcttatatttctctttttcaccttcattccacaagagagaaatttgtgacatgtctcagtctagccttaatgtgataagattcatataaatagatatgagaatatagaaaacatttatttggactagacttcagactaaatttctgccataacattcaccaaactaagggattgcttatgtacagttctgaccctgaggctgacaaccagatattcttcccgttgaaacagaaaaactcatactattccactcagcctagaaatttcctagttatgtaccagtagatattataccaaccagattgccaactgtatttgaaagtcaatcagaaagcttctccttccaaaattctcaccctaatagaacactcaccagccaaatcctgcatgagccgtcttcctttcactctataaacctcactcgcctatcacgccccttgagtggctaccagaaggaaagtgatcatagctaactcactctagtcagatctgaaaaaacaggtttcagataattctatagacattgtctttttgacaaaacaaaaatgtattcttatggattggtgatataaatgagcactgccctgtgggctacctctgacatgaacaaaggtcggcagacatgtgctcctggaccgctcccgtatcgagcatcctcacccacccaaattggcctgtccttagaatggctggccttacgggttgtgcctctgtagtgagtgaggggaacccttttcagtttgtgctccccactcctctattctagctccctgaagcctgcatcctatgaagatgtattctcttggttccaagacagttcttcatacagccgataatcatggaagaaagtccacattcctttaagaagagatgtggacccggggaataaatggtaaggagttgtttgaaatgcttgttcccaggtgctgtaaagaaatagtacttgaacataaatttaatttatttagtaaggccatttttacttcctgcagaaagagtacactcaccagaagttttgcccttggtgagaaatgtatccagcctatactggcttatcctcattccaaaacactaaagcaactaagagggttccttggcataacaggcttctgccgaatatggattcccaggtacggcgaaatagccaggtcattatatacactaattaagaaaactcagaaagccaatacccatttagtaagatggacacctgaagcagaagtggttttccaggccctaaaggccctaaccaagccccagtgttaagcttgccaacagggcaagacttttccttatatgcaacagaaaaaaacaggaatagctctaggagtccttacacaggtccgagggaccagcttgcaacccatggcatacttgagtaaggaaactgatgcagtgacaacgggttggcctcattttttactggtagtggcagcagtagcagtcttagtatctgaagcagttaaaatgatacagggaagagatctcactgtgtggagacttgtggctgtcagacaaccatttgcttaaacatcaggctctattacttgagggaccagtgctgcgactgcacacttgtgcaactcttaatccagccacatttcttccaggcaatgaagaaaaaaatagaacataactgtcaacaagtaattgctcaaaccttcaccactcgaggggaccttctagagattcccttgactgatcctggcctcaacttgtatactgatggaagttcctttgtagaaaaaggacttcgaaaagcggggtatgcagtggtcagtgataatggaatacttgaaagtaatcccctcactccaggaactagcgctcagctggcagaactaatagccctcacttgggcaccagaattagaagaaggaaaaagggtaaatatatatacagactctaagtatgcttacctagtcctccatgcccacacagcaatatggagagaaagggaattcctaacttccgagggaacacctatcaaacatcaggaagccattaggagattattattagctgtacagaaacctaaagaggtggcagtcttacactgtcggggtcatcggaagggaactgccaagtggatattgaagccaaaagagccacaaggtgggaccctccattagaaatgcttgtagaaggacccctagtgtggggtaatcccctctgtactcagcaggagaaatagaatggggaacctcacggggacatagtttcctcccctcaggatggctagccaccaaagaagggaaaatacttttgcctgcagctaaccaatggaaattacttaaaacccttcaccaaacctttcacttagccattgatagcacccatcagatggccaaatcattatttatgggaccaggccttttcaaaactatcaagcagatagtcagggcctgtgaagtgtgccaaagaaataatctcctgcactgcaggccatacatttcaatccctgtatctttaacctccttgttaagtttgtctcttccagaatcgaagctgtaaaactacaaatcgttcttcaaatggagccccagaagcagtccatgactaagatctaccgtggacccctggaccggcctgctagcccatgctctgatgttaatgacatcgaaggcacccctcccgaggaaatctcaattgcacgacccctactacgtcccaattcagcaggaagcagttagagcggtctttggccaacctccccaacagcacttgggttttcctgttgagaggtggtactaagagataggactagctggatttcctaggctgactaagaatccctaagcctagctgggaaggtgactgcatccacctttaagcacggggcttgcaacttagctcacaccagaccagtcaggtagtaaagagagctcactaaaatgctaattaggctaaaacaggaggtaaagaaatagccaatcatctatcacgtgagagcacaggggaagggacaatgattgggacataaacccaggcattcgagccggcaacggcaaccccctttgggtcccctcccattttatggaagctctgttttcactctattaaatcttgcaactgaaaaaaaaaaaaagatgggctagaggcaggaaccaagttctttgaatgctgtgaggagaaacattccacccagactgaggcgtggtgggagcaggggcaaaggagatgaagcaggagctgaaaagctctaaaatctgagttttagaggagatgctgaattcagcaaggtgtagaaagttgggtaggatatttgagtatgttttaccagatcctcatgaccttattgtagctattacagggcagaaatttgtcttaaacctagcagagaaccactacgtagaataatttgctattccataaatattcctttctgttgactcccaaatttttttttatttttttatttttatttttattttttgagacagagtcttgctctgtcacttaggctggagtgcagtagcatgatcatggctcactgcagccttgacttcctggacttaagtgatcctcccaccctagcctcctgagtagctggaactacaggcacatgccaccacacctagataacttcttaattttgtttttttagagatgcggtttcactttgttgcccaggctggtcttaaactcctgggcttaagtgatcttcacacctcagcctcccaaagtgctaggattacaggcatgagacattgcacccggccaactccaaatttttagacagagctctattcctttaaccaattgcatattaaagagtctctgaatccacctataaactaagcttctgtttcaagttatcccacctttttggggcaaaccactgcataccttccatgcattgatttatgcctttccctataactcctgcttccctaaaatatctaaaagcaaactgtaattccgaccgctggggcacactttctcaggacctcttgagactgtgttccccaggtcattgacacttgtattggctcagaataaacctctttaaaatattttacaggctactctctgcctagggggtagcactgctctacaggagcagtcatggtgctgtaacactgcctcttcagtaaagctgttttcttccacctctggcttgctcttgaattctttcctgggcaaagccaaaaacctacatgggctaagctccacgttggggctcccctgacctgcatcagtttctctaatctcttactgctcaggagtcaagtggccagaggtcacaaaatttgtgacttccccagttgctcctatagataacatcactattgtagaacctaagattggtcaggtagtgaagagctgaccccatctggacttgtgactcatgacttaattggtcctgtggccctcctccagagggggactcagtgcatgaggattgttttctacacacctatgattgcattcccaaccaatcagcagcatccattcccttgcccctgcccaccaaactatcattgaaaaaccctaacctctgagccctcaggaagactgatttgagtgataactccagtccttctgcttggctgctttgcattaattaaactctttactgcgaaaaattttatatatataaaatattaaatattatatataaatatataataatagtaaatattatatataaatatataatattaatagtaaatattatatataaatatatgatattaatagtaaatattatatataaatatatgatatttatagtaaatattatatataaatatatgatatttatagtaaatattatatataaatatataatattaatagtaaatattataaaatatgtattatacattacagagtctggcttttcagttaacataatcaagaaactgaaaaaagactatctctgctgaaaaataaacaaaccaaaaaccatggcaaagaaactttcacaacaatgcctacccctgttaccccagacaaattgataacacacaa

SEQ ID NO: 213 - DNA, 10000 bp, Homo Sapien
tacagttgtccatttgttctatgaagttgccatgtgtattagatcagttcgtctctctttttcattttggtacctgttttaatttttatctccaaatttttagagtttgttgtttataggattgaaaaaatctataagcatcttattttacatcttatttttttagaatgttaatactttatggagcctttttcaaatgctgaactggtgtttgttttttaacttttattttaggttcacggggtacatgtgaagatttgttacttaggtaaacccatgtcatgggggtttgttgtacagattatttaatcactcaggtattaagcccagtacccaattgttatcttttctaatcctctccctcctcccatcttccattctcaagtagaccccagtgtctgttgtttccttctttgtgttcataaattctcatcatttagctcccatttataagtgagaacatgtggtatctggttttcttttcctctgttggtttgctgaggataatagcctctagctacatccatgttcccacaaaagttataatctggttcttttttatggctgcatggtattccatggtgtgtatgtaccacattttctttatccaatctgttgttggtggaaatataggttttcatgaaaagattccaagtttttgctattgtgaatagtgctgcagtgaacattcacgtgcacatgtctttatggtaaaatgatttatatttctctgggtatatatccagtaatgggattgttgggtcgaatggcagttctgcttttagctctttgaggaatcaccatactgctttccataatggttgaactaatttacactcccaccaacagggtgtaagtgttccctttttttcacaacctcaccagcatctgttattttttgactttttagtaacaggcattctgactggtgtgagatggtatctaattgtggtttatatttgcattctctaatgatcagtgatattgagcattttctcataagtttgttggtctcatatatgtcttctttagaaaagtgactattcatgccctttacctactttttaatgggattctttttttctcttataaacttgtttaagttccttatagaggctggatattaggcctttgtcagatgcgtagtttgcaaaaattttctcccattctggaggttgtctgtttactctgttgacagttttttttttgtttttttttttgctgtgcagaagctcttaagtgtaattagataccatttgtcaatttttgtttttatcatgattgtttttggtgtctttgtcattcaaaattgacatagaaaattctcacattgttgcagcattttaaaaaatctgttactaagtataatatacactaagaccctaatttggtttactaattttttttaaaggaaacacaccatatgttgataaaggtttatctaggcagttaagattatactaacttttattttttctttgtatcacctaaattttccacagtaaacaattttttataatctgctttttttaaaaaataaaacatagtaggaagtcattaaactcgggtctagtcttaattgtgccttaagctgtgtttctttgcattctctcttcggccttatgtttccagtttaacttataaatttatcttccaaatttctgatccctctgaaatcttataactaacatatttagttttaccttttgattttgatttaaagaataagacaacatttctgattcactttttcaatatttcttatttgctattgccatatatttcagaaactacttgtggtttatttctgcagttcatgttctttggtggaatgagagtgcagatagtcgtgcagctgggagacataagtcccatgaggatcccagagttgtggcggctggtaagctgtttcactaagcacgaattatttttagaacaaatgtgattcaaccaataactgtatgccttcttatgaaatgtttttccagttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggtaagttaattagttaatttgctgtgcttcttgcatttttgaaagttacatattctccactgctttaagaaataattcagttcactttcaccttggcatttcagtatctgttacacattagaagtagttgtcactatttcatcatcttggtttttcatttgttttagaatacctcttctgtattttgataactcattgctttatagcattttcttttactcaaataaggattttacatttccttgcctgacagtatttttgaattatttatataaaatatctatcttttcatcatgtctatagttcctgagattttaaaaaaatttgcttagtaaaggttattttgtgatataaaatgggatttataaaaatattagattgtttatttctttactgtggaaaagtagaatgtcatctgtattaattattgcttttacattcattgattattagtcattctaacttggaaaataatgcaattgggtcacagtgttaaaaatctagaaaagacttgttggtttatatgctgaaattgttcatttataattaattttactaatttctacttagtttggatcactaacagagatcttgggacatttatttgttttaaagaaatatttatggttatggaaacgcttgccctaataaaaatcctgcatattcattgtttttttaaattcacattttatacttatatgatctctaaagctcttgctatgttgctataagacagtaatatagtgataatttaccaactttattgaaaatgttgttacatcaataaaatagcatgctgggaacctgagaaggaaggtttctttagtactgccacagatgtcctggagttttccttgaaacatctttcatttccattttacttgatgcctctacctactaaaactagatttggtacttccgatagtgtatatttacagctatattatatttacatttttacagactatcttctgataatctgtatttacagctatgttattttatatttttaaaatcttacagctataaaatagtaaattgtgaattagctgtccaagggcaatttggaaaacaaactgtacagtttcctctcatttatcaggctctaagcgatctgcagtttatctgggctattatgcaatgtgagatattatttatgagaggcaggcagtggcagcttaaacagacatacctcctcagcattcttttccatgcagagttcaaagaggcctaagacatctcacatttatgtgaaatagttgaggcacaagtatgtggttaactacacataaattaccaataaaattaaaagttaactaaaatactacagaagacatttaatattttgcttcagactgttatagtaccttagggttatgaacatcaattacctttgagccttactatatttaaagggaaggggaagctgacatttttatcttttttaatgggtacactctacgttaccttaaaggcttccccggtttaagcaaaaatagaattatgtggtttaaatcatataccttattcttcatacttagctccaagtagattatgacttttcctaaaacttaacatgacagagatttgccttccagggggtctaatttgaagaggaaagtaatttaaatgtataggtttatataatagcattgtatttttctctattttattcattctttcattctcttcgatgactcccagcacctgcgcgtccatcttcattcttagccaatgacctttccttttacttaacagagaaaataacaatcagaagagtcttcataagttcccaccccgtctgcccgctttctacagccaaccccacatgccctgccttctctcctttcactgtggatgaaccgcccgtgccccaagcaaagacaaaccctccacttgaacactcacttgctgaaggatgtggcttaggcagttttcctgtctcctgaagccacagtattccccttcaactggattcttctcctcagcatataaatatacttttttttcctatctttaaaaaaaaaaaagagtaaaatcaccccatttttttcctttacaatatgactcaaaagagtagttcatacttcctgcctccattttcttccctcacattatctcttaaacattctctgatcacgccagccaaattgctcttgtcaactcatttcccagttctcatttcacttgacttgttagcagttgacctctcctttcttctggaaagtttcttcgtttctccgaaacactcactgcacaagccttcatatctcctagtctccatcttgtctctttgacctctgatgtaaggactgagtccttggaccacttctcttttctatttatacttactccctgcgtcatcacccccagtcttgtggcttcaaatgctatctgtgtgtggatagctcctccagtccacacctcttttctgaatcttttttcaaattcacacatgtgaatttgaattccaggctcatcacatccaggtgtgttccccacacctccacctgaatgtctattagaaatctcacacccctcttgtccaaaactgagctcttgatctttaaccagaaactttatctcagctattggcaactccaggtttctgttttgctcaggccacagacttcagagtcattctcacactgccttttctctcatacaccattatgtacctgtcagcaggtcccaaatatctagaatttgattgcttcacatccctatagcaactctcctggttcaagcccatcatcatctggatttttgggaagtggtcttaactggtgtgctgcccttcccctctgctctcaaccctattttcaacatagcagtcagaataatctaaaatataaaccagatcatatcactcctctgctcaacaccccctcccaataccttcatgtcatcctcagagttattgtccaagcctctaactgtggtctacaagtctttacatgatctgtcctgttacattttccactctcgctccagacctgacctaagaggcttttctctgaacttgctaaacatgctcttacctgagggtccattcccactgcctctgcctggaatgctcttccccagacatgcatctgcgtggatcatttccatgcctcctcaggtctttgccctcatgaagccttccctgacaaccctatttaagattgtaatcccctcccacagtggcccctatctgctagagactgaatgtttttgtcccccccaaaattcctatgttgaagccttaatctcaacataggaggtttggcctttgtgagttagttttagatgaggtcatgtgggtaatagaattagtgcatttataagggcgtgaagagccctcactgtgaggaaaccagaatgtaagccttcaccagaacttcttcatgctggcaccctggtcttagacttcccagccactagatctgtgagaaagaaatgtttgttgtttaagccaccctgtctatggtactcttgttacagcaacctgaactaagacactatccctctcccctgctttctttttctgttatcaccataattaatgttttacttatatatgatttgttaatgtatgtctcttcccactagaaaccgaattctatgacagcaagggtttttgttttcattattgtcatattacctgtgcctggcatgtgataagccctaagtacttgttgactgaattaacatatgagatctgtgagtctgaaaaaagaagtacatcattccttcacatgtcattttgagccactgttaacagattacataactgttattggaagtgcctcactactccatttggaaagtattcctggaatacacgatgaatgactcagtagaagttctggctatgggggagtgccatcaataaataaaaataataccattgtctgttggttataagttgctgtcacagactatgaaggtatttgaattgtattttcaggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggtttgttttctttagtgacagttggcccaggatcctaaggtaaaggagtatgggcactagacaaaatgagttttataatagtcgattggaaggaatggaagtttttgaatcacaggcttctgccttgaaagggcaagtccgtggtggtcatgaaccacccagagtgtgtacaaggctcctgccagaagaaatgcctgtaggattaaaagcaaaacagcagaatcaaaaaggaagggcacgatgatgcccaggtgcagcctatattattaacagacaaggaaagaatccaaataaaagttctgtaaaccagctgttgtcctgttttctgtttcccttcaaagcaaaaatatagatttgcatatatttgcagtctccccttccttgcctctcagtcttccctgaaaatctattccagttaggtctgcatccttgtcatgctgaaatgactcttatgaaggtcaccaaggacctctgtcttaacaaattcaatagccattcctgcctttactcatttacattccttactcatcttctcagcaatgttggatataattgacaacttctgccttcctgaaacaataattctctgagcttcaacatatggcattatactcttcagattttactctctctcactggccagtccctctcaatttccctggctagcttctcttctaaatgttataggatctcaggctcaagaatgttccctatcttcattctctctaggtaatctcattcagtcccgaggcttaaatatatacgtaccaataacttgcacacttttttttttagatggagtttcgctcttgttgcccaggctggagtgcaatggtgcgatctcagctcactgaaacctccgcctcccaggtgcaagcgattctcttgtctcagcctcccaagtagcttggattacaggcatgcaccaccatgcccagctaatttttttgtatttattagagatggggtttcaccatgttaggctggtcgcaaacgcctgacctcaagtgatccacccgtctcggcctcccaaagtgctgtgattataggcgtgcaccaccacgcccagccaacttgcacacatttatcttattttccatcattgcccctgagcttcagactgaaatacccactgcatttttaacacaaccatctacctagttcaggtcacaaactagaagtcaccttgctagctctctttccctcagcccttacatgcagtctgtcagcaagtcctgctggatctatctccaaagtggatactgaacattaccatagctccctatctgttgctaccatcttagttcaatccaccattatctattagtcttcctactgtcctttcttcccatagtagccagtgttctttctgaaacagtaggtcacaccactactgtttaaaactctccagtggctccttgttgcactaacaataaaatccaaataccttaaaaaggctggcgagatcctgtgagatgtggtccctgctatctctccagttccaccccctgccactcttgtccttgctaactcagtacaagagacattagtacagatagctcttttaccacctcagcttgccaagctttttcccactggggcttttgcaacacttattctttcttccgggaatatccttcgcacccaccttgaaaggctgctcctgctctttttattcgattctgagcatgtcactcctcagaaaaggccatctctgacttctctccattgttatccaattaccatgtcttattttcttcttagcacccattgctgtcaaaatacattagatgtgtttgtccacacatcatctttcaccactgaaatataaattcattagagcaggaattctattttcttctacattgtaccccctagtacctagagaagtatctggcatacagtaaagttcaataaatatttgttaaattaatgtatattgatgctgatgtgattttacaaggtcaattttaactgatacctaacttcaacaaaaagaaccctctgccacttgactgaacctgtacctttggacgagtttcttatccactgagctgtaatttactcatatgtaaaatggtactttttacctcatagggcaggtgttgagaattaaatgaagtgcatgacaacacagtaaacacttgaaaactgaagctaagtgggttttttttttttttttacttaatgtaaacattaccattacaaagtgccaagttttttgaatctggaaaagttcttttgggcttttctacagatagaagaatgttttagtcaaggctcatgggtagggccaggcaaggtggctcatgcctgtaatcccagcactttgggagcccaaggcagaaggatcaccttaggtcaggagtttgagaccagcctggccaacgtatagtgaaaccccatctctactaaaaatacaaaaattagctggttgtggtggcgcatgcctgtagtaccagctacttgggaagctgaggagaatcgcttgaacccgggaggcggaggttgcagtgagccaagatcatgccgctgcactccagcctggacgacagagcgagattctgtttctcaaaaacaaaaacaaaaagcaaaaacaaaacctcatgggtaacatattttcatctaaattacctgcctttttatttttcaataaagttttttcctctccctcgtcattgttcacgaagaaacagtgttctatgatttcattaaagtcactataacatgaacttcaagataggaggatgaagttgtgatgctgatgctcagggggcatcttggctcacttgaagccaagatttttctgcacacaaagttcagatctgtgccacaggaaaaggactgctcacgacactgtcacagccattcctgaggtcacaaatagagacagcctcttgtacttcctcaaaaggactgtttgacagggattcttcaagtagcaaaataagcagacatctctttctgaaactgattcttaatgagctatgaaaaatacatttacatttatcagcactgctcatatgttgtctgcacagcacttattacaggaaaaaaggaaggaatcaccgatattagtatcatttctgtttccatatctacttcgccttcctgctcaccattgccaccacccccagcaccttcccagtataactgctacattgtgtccttatatttttggttgaataaacaaaaggacactgaaggctgcctttgtagcttcccctataccaagtgaacatttattaaataagctcagctacagagcattttcagaaatctcagtgcagcttcataatcattaagcagaatatttatctaaaaacctctaacacttaataccagttactcagtatcttaaccaacatgaaaatacaaaacaaccttttattttcaagtagtcccctcagttctcttttatgattaagggaacatttgaatcttttctaaagtttttccttttgatccaaatcacttcccctctacttttctaatggctttataacccttcaacagtaggtggtgccacaaatgcacaaaagtaaatttctg

SEQ ID NO: 214 - DNA, 10000 bp, Homo Sapien
acattgagataacagaaaaaactaggacatttaacatgttcccctttcttttgcagttgcatatgacacatttttaccactaggacatactagggtacaaaaatagcaggtgtatttccctcccattctaacccgtctttcatgtccatcatctgtccactaacatctctcaaccaaactgcacgtacgaaagcgaggacatacaagtaactagaaagttaaaaagcagaaatgcaggctgggtgcagtggctcatgcctgtaatcccagcactttgggaggctgaggcaggcggatcatgaggtcaggagatggagaccatactggctaacactgtgaaaccctgtctctactaaaaatacaaaaaaattagccaggcatggtggcatgcacctgtagtcccagctactcgggaggctgaggtaggagaatcgcttgaacccgggaggcggaggttgcagtgaggtgagatcgtgctagtgcactccagcctgggcgacagagcaagactctgtctcaaaaaaacaaaacaaaacaaaacaaacaaaaacaaatgcagagggagaatggtcattgactaagagttttagatttttttttccccctgcgatgtctgggtgttagataaataatagttgaatatgcagctgagtcatccaaggcaaatcatttcatctcttagggcctattaaatgaggactcacaaacggattgaagttaaactaatacaaatttaaatccctggagcaattaggatatttggtttcaaggctgacacgcatttcagcttagagttcttttaaagaaaagtatgcacatatccacaaagattttcaaattctgctattcagtggccactaaggtctcctgtgacccttcatcaaaagaagcaacacaagcaacaagcaatgatttttaaaaagacactatgagcagaaggtctaaatactgttctgagagactagcaacaggacactagggctgagaaagccagtatggcacggaggcaggaagtgactggaggtgctcttggcccaaggtagctcaaaaaaagtatgaagattataatttttccaaaaactttctgggaattactatcttgatactcagggctaatttcaccttttaatgcaattgtgtaaagaagtacaagcttataaactcacagccccaaatgaacaaggcctgagggaagagtgtgcaaaaaaaaaaaagaaagactgaaatgcaaatataaagtaagacacatcttactggcacaactctttccttagaactgaagaatagatgtcattcccaatactatgaggacagtgccaagaacacgggatatatgctggctagggaaaaaaatggataagcccgtacctttagcctttaatatgaattgagaaacgtcaagctgagtattgttctaactcttatcaatcagtaccaggtttgtaagcaccccaaactatctaacctgcagcacatcactatcagtcagctcatcttcacattaagtagaagtctccattagccaaagctacatatagaaaccatcctatctaccttatctattatgctgaaatctacttttgataacttctattactaacaaatctaattcttctctactaaaaccaccctagttctgttagagatcctttgctcccttttgggggaagcagggtggaggggcatggggtgggttgggttatgaccaagtaaaagggaacaaacaaaacacttccagtctgtctgcaacaagattaagtgctgagttaccaggaaatgtaacaacaaatcatcatccatttgggctacaagatttggcacttgtgatgatctgaattgaagccaaaaagataatttctgaataatattaaaaataatgacttcttggcagagcttgacatggggagggcagtccaatcttggcatcctttgccaggctgggatgtgcaatgtcctcttctgcatttttttaaataagctgtgctttttggtttggtttaaaggtggttcctcctaaaggaggaggaatctataaaaacaaaaatgtaaggggatgtttcgataactttattgaggaagttctcaatcaaatgatagagggttttaccagcattatcacgactcacattttgtatttaaaaatgggtaacactctttgtgcttttaccaaaatagtctgtcaaatggggctggaatcctaacatttgttttaagctctgcctcttttttgcctcaatggagactgccatgatttccttcagaaatgccattttcaaacgcagaataaggcattgttctcaaaaaaacattttaagtgtataagtaaaaccaatttatatatatatatatacacacacacacacacacacacttattattattttttaaataaagacgaggtggtctctattaaaaaataataatattgcccatgctggtctcgaactcctgggctcaagtgatcctcccactttggcctcccaaagtgctgggattacaggcatgagccaccatgtccagcctaaaaccaatttttaaattataaaaatacatggtaaacagtcaagacttgaaaaatagtgcagacagcacaaaagtctgagacaaatatccagctggtgtgggacatcttgggatagataatcatgtccttccaaggtcaagacagccaccaaatgaaggtctaacaaggctaaacacaccctcaaagcgacaatgccagactgatcactggaacctccagtaactgttcccttaagaaagagacactgaattttctctcatgaattctctgactttccagcttgtgcctcagatgtttgctttgaacattcgtgggtacactgtgagagacgagggaaacctactgactattgccaagaagaatcatagaaaatgcagttgatttctgatttatccaggccctctggggaaggaaatgcctcctttccttcaggcatttctgaaggaaatcatggcagtcttcagcgaggcaaagaagaggcagagcttaaaacaaatactaggattccagcctgtatcttccctccagacttcacctactggccatttcacggctggtaaaaatctccatcaatgtaggcaaaggggagtctaaacttttttggtggggggggggttgcttttttgtattctttagtattcttaatagaaacctggtaatgtaacgaaaatacaagtttaatcacttgctgcttgcagaatccaattcacaagagtgaggtctggtacgaagaaagtgactttattccaaagctagcttaggggaagaagtataggctcctgcctttaaggtactgtttcccttctgggacaaaaaacaagggcttttacagggggacttggcataaatggcatgcagaagagggtgcaagcaggtgcacggtctatgtgacttcttgggtgccttatctacccgatggtcaagctgacgccattgtgggcagagctagattgtaaaatggccattgtttcaagacacttggacagagttccctcatgggcctaactgaggttgtaaattgactgttgtctcttaaggccttctcctggtgggagagagtcccagctctcaagcattgaagtgagcacatacataagcttgccatgcagggagtgtctggtaaaagggaaggtaaaagttatgattccatttctaaagagctaagcaggaagtagagaacagggaaaaaggctgaaagagaaaagaaaaaaattgttttttaagtaactcattctctttctcttagaaaaatggagtactcagttatagtaggaaaagactcaaattataatccaaattaaggtatttttaaaaaatgttctttcttccatttttactagtgaacagataagcactcttgcaaaaaaaaaaaggaaatgtcagaaagaaaatatggagttggtttagtcactagtaaaatgtacagaaacgatgtgaataaaagagatgaagacaactgcctgcctactgaaaaatatccaatgcactggttttagaaacagcgtgtatagcttcatgtggtatatatgaagaatgtgggtgttggagtcagtagatctgggttggaattcccatttgtcccttcctagctgtaatctcaaattacctctcctgtaaaaccaggctcataatacacagattgtaaaggagaattagatgagaacatgtagaaggtgcctagcacagaacccagcccatggtggaccttctagaattactgattgcccctccccttgtcttattgcctgtcatatcagggctaatatatcagcttgaggtatatatacagtatctagatccttaaggttgttaaaagaatctccctattcccacagactttggtctccatcagaaaaagtgacagacattcaaccagactttcatataactcagtgacaagacaaaaatgaggatccatgacttccatatcttgaagcaaaataccaccaaaaaccgtgaggctgaaatcgaaaaggcagtaggagacacaaggcacccattcaaaacaagaatgtattgtatagttattacactaaataccaccatatttattacactaactcttttttctccctctagaaaactaatgatgatacaattgattttgattatactgttctacttcatgaattatcaacacaggtaaaacataacattgtatgtagaattgtttttaccataagtttttgcagattataatattttataactctatttcctaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaaataatgaaatgtgttgaatgttctcgtgaagatttgtatacaaaggaaaaatttgtgctaaactggaattaaatgaaatggtaatattgcttaacttaaattttacaaataatagaacgtctgtctcaccagataaagctgtctgcaaacatgcatcaaaagaaacactgatgtaactgaaagtatattaaatatttacaattttcatttacaaggacaacttggactgagtgttggcctaagtaatttataaaggcaaacacagtatgtacaataatcaaattcagtggagtacctccttaaggcaggaggcattgatccaggaaatgttgtcatcatttgcctctcaaaattagtatcacttaatggaatgtttatgtcggtgtgtaaaaaccttgagccaggttctgtagccagtaactgattaggaaatatcagccttaaaacataccaaaacattacttctaagtgtgcactgttagacaatcagaaaagtttacactaaagaaggcatgaactcatataaaataaaataagctgatctagtttatatatttttctacttaaaaccctatgctttgcatttatcttcccaaaatccagctgatttacaattaaaaaaaatttttttaattaaaaaaaaaaaaacggctgggcgtgatggctcacgcctgtaatctcagcactttgggaggctgaggtaggaggatcacttgagcccaggagttcatgactagcctggacaacatagtgagactccatctctttaaaaaagtttaatgatttaaagatttgtggctgggtgtggtggctcattcctgcattttgggaggccaaaggcaggaggatcacttaagcccaggagttcaagatcggcctgggcagcatagtgaaatccagtcttaatttaaaaaaatacatatatatatatataaaaataaagagttgtaggtatttggaagcattgcaaacaatcatttaaaagacacatcagctctcccacctatgtgataatgaagagatactccttgtaaattatcagaaataatccacaatgattaaattatgccaaaatcaagtgataaatttctgtaactgaagttccccaaatgatcttcaaaaaaagtcctaagagcattacaacagtatattcaatgtcctatgatatttaatcaatcttttagcgtcacattaaggactagaaaagggcatttacttggtgtttcagctttctagagtcggagctttctcaaagtcctcatccccataaatgcatttttcttttttcctttttttgtttgtttgtttgatcttcactgggcagctatcttgactttggaaggaaatggttatctatcccaggatgtcccacaccagctgattatgttgcccaggctggtctcaaactcctaggctaaagggatcctcccacctcggcctcccaaagtgttggaattacaggcatgagccactaaaggcatttttcattactgagattaggctcacaaacacatccataatccaaccaggtaatgtttctaaggtaaccttttagcagatttattacagtacaatagattatgagggggaattctatacatacaaataatatacaaacacaattacctaatttattaatttacaaaacccaaaaagttaaaccaactaaaaatttatcagtatcaccatcagaacatcttttcttttttttcttttttttttgagacagagtctcactctgttgcctaggctggagtgctggagtgctggagtgcagtggtgccatctcagctcactatagcctccgccttccgggttcaagcgaccctcctgcctcagcctcctgagcagctggggctacaggcgtgagccaccccgcccggacgatttttgtatttatagtagagacggggtttcaccgtgttggccagggtggtctcgaactcctgacctcaggttatccacccaccttggcctcccaaagtgctggaattacaggcgtgagccaccacatccggcctcagaatatcttttctagcacaaactctaaaattgttaacttaattttaccaacattggtttcactagctaataaaacagaaaaatcacttggcataaaatgaaaaactattccctatgtcctcttttcattaacagtctaaattattctgaatcactcttagctaattacaattacatacagcttgacattcattttcctaatacctttagaactttcttaagacatataaaataataccagggattttgtctacattccattttattttattcatactttcattttcttcctacctgaattacgaatttttagaagttgaacaagttcttttgaaagtcagttggaagcttatataaataggaacacttttttttttaaggtaaagttatcaagccaggcatggtggtgtgtgcctcttgtcccagctactccagaggctgaggccagaggactgcttgagctcatgaatttgtgagcagcctgggaaacacagcgagaccccatctctttaagttcaggggttgatgtgcaggcttgttacatagctaaacttgtgtcctgggggtttgttgtacagattatttcatcatcaaggtattaagcctagtacccattagttatttttcctgatcctctccctccacccaccctccatcctccaataggccccagtgtgtgttgttcccctctgtgtgtccatgtgttctcattatttagctcccacttataagtgagaacatgcagtatttggttttcttttcctatgttagtttgatgaggataatggcttccagctccatctatgtccctgcaaaggacttgatctcattctttttttatggctgcatagtattccacaatgtgtatgtaccacattttctttatccagtctatcagtgataggcatttaggttgattccatatctttgccattatgaacagttctgcaatgaatgtgtgcatgcatgtgtctttataatagaatgatttacgttcctttgggtatatagtaatggtattgctgagtcagatggtttttgtcttagaagaccccatctcttaaaaaaaaaaacagttgttaaacaaaaaaaccaaactctaatatcacacaaaagaatacaatatgacacttctgaatttcacagatttttcatttcatgtcttgggcttaagcgcagtgcaggcaatatttcagcggtctttaactttgtctgcatattagaatcacccaaaaaagtttttatcttgatccagccaaataatctaaatatctgggtgtaggcctaggtatttctttttaaggctcccccagtgatttttaaagtacagtgagggttgggaatcagtacaatactacctagtgctgctactgttgtccaatacaaggatgtaatatttgaattagccaacaattatccttcttgatagtagtataaacaaccctcacctatgaatattctcattaatttttttccatgctacagactttggttggtatgtgatctttgccaactataactaatgacttagaaagagatgtgggttctagtcctgatctgtccatttgtgaacctattctaattactcccaccagctaggcctgaatcattacctatgaaatgctggtgttggattaaatatctaggaccttttctaacactgtaacattataaccaggatgttttacaaattaaaaataagtaagttttttacttatttatccagtttagttccagtagttgtgactattctcaatagccataggaatcatgctaaattccatgaaggtacacagaatgtatttcctcattaggaacaatattcaaagttattgtgaatgtcacaagatgctgaggaaatgccaaagcaaccacattttttcagacctgatgctactgtagcaacagacattcatgggggaaatgcacttggtgaataattgtaattaaagtatcaattaaaaaacttaggttttgtggtctcattaaagttatttaccttatctgtgcttcttctattacaaaatggacataataatagtacttactctcggggttgtgagaatgaaattatacaatgcatttaaagtatttagcagccaggcatggtggttcatgcccataatcccagcactttgggaggctggggcaggcagagagcttgagcccaggagtttgagaccagcctgggcaatatggcaaaaccctatctcttcaaaaaatgcaaaaaattagcagggagtggtggcgcacacctgtagtcccacctacttaggcagctgagatgggataattgcttgaacccaggaagcagaggttgtagtgagcagagatagtccctctgcattccagcctgggggatagagtgagaccctaccacaaaaaaataaaaattaaaaaaaaaaaagtatttagcaaatgccttgaaaacatgtgctcaatactttttaaagatctttttcccctagaaaccttaaagtataaagccacgtctataagtcaagaaaagcaaagga

SEQ ID NO: 215 - DNA, 10000 bp, Homo Sapien
gctacaaaccttttcacaaccacattttagaaatatgtcccctctgcctaacatattctttctccactctccatctgtaaagtcactcatcctataagactcagctcaactgatgctactgtggattcatcccgagtccccagagctactgtttccatcattctcttctcatactgctgtgtacctgctccattaaagccgctgtccactctattgtaaatacaacctgtctttcccattcatctgagatacagagaaaaagaaggtacatattttatttagttttgtttcttaacttccttatggcctgttgcagtgctcagtacaataaaagtctaataaatgaagttatggacaactagtaaatggtttgtttatattgtttcccaaatctgttatttagtgaagaagggatttcaagggatgaaaagatttgatgtgggaaggatttagaaaatatctaagcatctaaatgtaaaagatggtctgtggtttaaaaaatacaatcactttttctctttttaaaacagtacaatagaaatctagagtggagcaggagagcatggcctcattgcatcgctgagtccttttccctcaaaaatgaattattttgattcttaactgtgggaacaagagaggtaaatttattcagaatttttccatgaaattccagtaagggggagaaaaaagcaatttgcatttatattgatggactgtgaattttcttcaattccagatctattatttcagttcagggaatggaagccactagagataaggaatcttcttcaccacttggttgttaccagtctgtaagctgaggcgcgggttgctgagtgccggaaaaatatgttccagcctcagtgcttgaccctccactaagatatttgaagatatggccgggcgtggtggctcacgcctgtaatcctagcactttgggaggcggaggccggtggatcataaggtcaagagactgggactatcctggccaacatggtgaaatcctgtctctactaaaaatacaaaacttaggagagatcaggttccaagatggtccaataggaacagctccagtctacagctcctagtgtgagcaacgcagaagatgggtgatttctgcattttcaactgaggttccgggtttatctcactgaggcttgttggacagtgggtgcaggacagttggtgcagcccactgagtgtaagctgaagcagggtggggcatcacctcacccgggaagcgcaattggtcagggaattccctttcctagcgaagggaagccgtgacagacggcacctggaaaatcgggtcactcccatcctaatactgcacttttccaatggtcttagcaaatggcacactaggagattatatcccgcgactggctgggagggtcccacgcccacggaggctcgctcgctgctagcacagcagtctgaaatcgaactgcaaggtggtagcgaggctgggggaggggtgcccgccattgctgaggcttgagtaggtaaacaaagccaccaggaggctcaaactgggaagagcccaccacagctcaaggagccctgactgtctctgtagactccacctctaggggcagggcatagatgaccaaaggcagcagaaacttctgcagacttaaacatccctgtctgacagctttgaagagagtagtggttctcccaacacggagtttgagatctgagaacggacagactgcctcctcaagtggattcctgacccccaaatagcctaactgggaggcacctcccagtagaggccaactgacacctcatacggcctggtgcccgtctgagataaagctttcagaggcaagatcaggcagcagcatttgccattctgcaatatttgctgtttggcagcctctgctggtggtacccaggcaaacagggtctggagtggacctccagcaaactccaacagacctgcagctgagggtcttcactgttagaaggaaaactaacaaagagaaaggacatctataccaaaaccccacctgcacgtcaccatcatcaaagaccaaaggtagctaaaaccacaaagatagggagaaaccagagcagaaaagctgaaaattctaaaaattagagtgcctctcctcctccaaaggaatgcagctcctcgccagcaagggaacaaagctggacggagaatgactttgataagttgagagaagaaggcttcagatgatcggtaataacaaacttctccgagctaaaggaggatgttcaaacccatcgcaaagaagctaaaaaccttgaaaaaagattagacgaatggctaactagaataaacagcgtagagaaaaccttaaatgacctaatggagctgaaaatcatggcacgagaactacatgacacatgcacatgagacatgctgatttgatcaactggaagaaagggtataagtgattgaagatcgaatgaatgaaatgaagcgaaaagagaagtttagagaaaaaaacagtaagaaaaaacaaacaaagcctccaagaaatataggactatgtgaaaagaccaaatctacatctgattggtgtacctgaaagtgacagggaaaatggaaccaagttggaaaacactctgcaggatattatccaggagaacttccccaacctagtaaggcaggccaacaatcaaattcaggaaatacagagaatgccacaaatatactcctcgagaagagcaactccaagacacataattgtcagattcaccaaagtagaaatgaaggaaaacatgttaagggcagccagagagaaaggttgggttacccacaaagggaagcccatcagactaacagtggatctcttggcagaaactctacaagccagaagagagtaggggccaatagtcaacattcttaaagaaaataattttcaacccagaatttcatatccagccaaactaagcttcataagtgcaggagaaataaaatcctttacagacaagcaaatgctgagcgattttgtcaccaccaggcctgccttacaagagctcctgaaggaagcactaaacatggaaaggaacaaccagtaccagccactgcaaaaacatgccaaattgtaaagaccatcgatgctaggaaggaactgcatcaactaacgagcaaaataaccagctaatattataatgacaggatcaaattaacacataacagtattaaccttaaatgtaaatgggctaaatgctccaattaaaagacacagactagcaaattgtataaagagtgaagacccatcagtgtgctatattcagaagagccatctcatgtgcagagacacacataggctcaaaataaagggatggaggaagatctaccaagcaaatgcaaaacaacaaaaaaagaaggggttgcaatcctagtctctgataaaagagactttataccaacaaagatcagaagagacaaagaaggccattacataatggtaaagggatcaattcaacaagaggagctacctatcctaaatatatatgcacccaatacaggagcaaccagattcataaagcaagtccttagagacctacaaagagacttagactcccacacaataataatgagagatttaacaccccactgtcaatattagacagatcaacgagacagaaagttaacaaggatatccaggaattgaactcagctctgcaccaagcagacctaatacacatctacagaactctccaccccaaatcaacagaatatacattcttctcagcaccacatcacaattattccaaaattgaccacatagttggaaataaagcactcctcagcaaatgtaaaagaacggaaattataacaaactgtctctcagaccacagtgcaatcaaactagaactcaggattaagaaactcactcaaaactgctcaactacatggaaacagaacaacctgctcctgaatgacatctgggtgcataatgaaatgaaagcagaaataaataggttctttcaaaccaatgagagcaaagacacaacataccagaatctctggcacacatttaaagcagtgtgtagagggaaatttatagcactaaatgcccacaagagaaagcaggaaagatctaaaattgacaccctaaaatcacaattaaaagaactagagaagcaagagcaaacacattcaaaagctagcagaaggcaagaaataactaagatcagagcagaactgaaggaaatagagacacaaaaaacccttcaaaaaataaatgaatccaggagctggttttttgaaaagatcaacaaaactgatagtccactagcaagacaaataaagaagaaaagagagaagaatcaaatagatgcaataaaaaatgatagaggggatatcaccgctgatcccacagaaatacaaaccaccataagagaatattataaacacctctacgcaaataaactagaaaatctagaagaaatggatacattcctggacacatacaccctcccaagactaaaccaggaagaagacgaatccctgaatagaccaataacaggctctgaaattgaggctataattaacagcctaccaaccaaaaaaagtccaggaatgtttatatggacttcagaggagagaataagttggcattgatcaggagaactgtaaggaaattaattgtttaggagagaaatgagatgtgatgaaggtgagaaagagcggattgaagcagcatgaaggtgatagaaatggcagagctgttgatcatttagtgaagagaactgggaagggatgcacccaggtttctgagagatgtccagttgtacacaggtaacgtctacagctcaagagccaggttagcgatatggatgaaataagtaaaatttgaaacttgaacctatggatacagttaaggtcatatgataagatcatgacaagatcatattataatgaaaagtagagggcctagaatcggaggaaaggaatctggataccaagcaaaggagttgagcaagaaaggaagggggctctggacatccttggaaggccgaagacgaaagggctaaaagtcgccaacaaacaaaatgagataagacctggggcatatcttttggccatggcagttaaaaaaggagtggtgaccttatcaggaggaatttcagagaatgttggggtggacttctaactgcagtggggtcaggagagaatcaaacgtgaaaaaaagacaacactctgtgtatacactttttataaagaagcttgatggagaatggaaaaatgaaaaggcagagttttatttccaaggtataaaaaatgaagactcccaataaactaggtattgatggaatgtatctcaaaataataagagctatttatgacaaacccacagccaatatcatactgaatgggcaaaagctggatgcattccctttgaaaaccggcacaagataaggacgccctctctcaccactcctattcaacatattattggaagttctggccagggcaatcaggcaagagaaagaaataaagcatattcaaataggatgagaggaagtcaaattgtccctgtttgcagatgacatgattgtatatttagaaaaccccattgtctcagccccaaatctccttaagctgataagcaacttcagcaaagtctcaggatacaaaatcaatgtgcaaaaatcacaagcattcctatacaccaataatagacaaacagggagccaaatcatgagtgaactcccattcacaattgctataaagagaataaaatacctaggaatacaacttacaaggaatgtgaaggacctcttcaaggagaactacaaaccactgctcaaggaaataagagaggacacaaacaaatggaaaaacattccatgcttatggataggaagaatcaatatggtgaaagtggccattctgcccagagtaatttatagattcaatgctacccctatcaagctaccagcgactttcttcacataattagaaaaaaaaaactactttaaatttcatatggaaccaaaaaagaccccacatagccaagagaatcctaagcaaaaagaacaaagctggaggcattacgctacctgactcaaactatactacaagactacagtaaccaaaacagcatggtactggtgccaaaacaggtatatagaccaatggaacagaacagaagcctcagaaataacaccacacatctataaccatctgatttttgacaaacccgacaaaaacaagcaatgggggaaggattccctatttaataaatggtgttgggaaaactggctagccatatgcagaaaaccgcaactggaccccttccttacatcttatacaaaaattaactcaagatgtaataaagtattaaatgtaagacctaaaaccatgaaaatcctagaagaaaacctaggcaataccattcaggacataggcatgggcaaagacgtcatgaataaaacaccaaaagcaatggcaacaaaagccaaaattgacaaatgggatccagcttcagcacagcaaaagaaactatcatcagaatgaacaggcaacctacagaatgggagaaaaattttggcaatctatccatctgacaaagggctaatatccagactgtaagaagaacttaaacaaatttacaagaaaaaaacaaacaacaccataaaaaaagtgggcgaaggatatgaacagacacttcttaaaagaagacatttatgcggccgacaaacatatgaaaaaagctcatcatcgctggtcattagagaaatgcaaatcaaaaccacaatgagataccatctcacgccagttggaatgacgatcattaaaaagtcaggaaacaacaggtgctagagaggatgtggagaaataggaatacttttacactgttggtgggagtgtaaattagttcaaccattgtggaagacggtgtggtaatttctcaaggatctggaaccagaaataccatatgatccagcaatcccattactgggtatatacccaaaggattataaatcattctactataaagacacaagcacacgtatgattattgtggcactgttcacaatagcaaagacttggaaccaactcaaatgcccatcaatgatagactggataaagaaaatgtggcacatatacaccatggaatactatgcagttcatgtcctttgcagggacatggatgaagctggaaaccatctttctcgggaaactaacacaagaacagaaaaccaaacaccgcatgttctcactcataagtgggagttgaacaatgagaacacatggacacagggaggggaacatcacacactggggcctgtcatgggggtggggtctaggggagggtagcattaggagaaatacctaatgtagatggcagattgatgggtacagtaaaccaccatggcatgtgtatacctacgtaacaaacctgcacgttctgcacatgtaccacagaacttaaagtataataattaacagtaataaaaaattaattaatgaaaaataaaatatataatctgatacatttggatatatgtatatatacacgtacacacctgtaaaaacaaactagatagtgaacatatccatcacaccaaagtatccccttctcctttatactgcctctcacccacctctctctgccctctcctcagttccatgttccatgcaactattgatctaccgtatgtcactatagatcagtttgcattttcttgaaatttatgtaagtaaaatcatatacaaaagtaaagaaagtgtgtttttaaaaatatataagatattgagtataattatgagataagacttcaaaaaagtgaagaggttaaagatgaaggagtgaaggtaaatatttgcttaactaatgtagtgagttaagtaatggattcaatcacagatgatttaatccactagtttacatattttactcacccaaggttagagtttactatttagacacttaacatttcttggcttactggacaatgtgagtcacctctccagaaaaattcatggcattgaatggatacgttaaaaaagtagaaactttgttttaaaaactctaaaatcaatcaccacagcttctactttagaatatcagaaaaagaagagtaaattaaacccaactaagcaaaacaaaataaataataaaaatgggggcagaaatgaatgaaatccagagagaaaatcaatgaaaacaaaagctagttcttttaaaagaccaatgaattgatgagactgtacccaggctaagcaaaaagaaaagcctaaattactaatatcagaaatgaaagtggtgaaatgctaaaaatcccatgtacagtaaaaaatcataaaggaatactcaggacagctctgtgcccacaaatttgataaactacatgacgtggatcaatttcttgaaagacacaatccgccaaaagtcacacaacaggaaatagaacatttgaataggcctatatctactaaaaaaattaatcaataattaatagccatctaaaataattaccagacccagatgggctcactggtaaattctaaaaacaaattaagaaaacgtttactccaattctctaaatctctttcagaagatagaagcagaagaactactttctaattcattctatagggctggaattactctgataacaaaaccagacaaagacattagaagaaaagaaacttaaagaccaatatctttcattagtatagatgcaaaatcctgaacaacatattcacaaatgaaatcaaactatgtgtaaaatagttggattatacattgtgactaagtaagattgattgcaggtgtacaagactaattcaacatttgaaaatcaaaggaatccgtcatatcaacaggtaaaaaacagaaaaaatcctcaaaaaattgctagcaactccaattcaacaacacattaaacagatcactcaccacgatcaagtgagattcacccgggtatgcaagtatgattcaatatacacaaatcaataaatgcgatacattgcattaaaagaaccaacaacaaaaactgcacgatcatttcaatagatgccgaaaatgtattcagtaaaatcctacatctctttatgataaaaatccttaacacattgggtatagaaggaatatacctcaaaacaataaaaaccaaaatgaaaaacccactgctaatatcatactgaacagggaaaaattgaaaacctttcctataagatctgcaacaagacaaggatgcccagtttcaccccctttattcagtatctgactggaagtcctggccggggcaattaggcaagaaaaagaaacaaaggacacccaaactggaaagaaagatgtaaaattagctttgctcaccaatggtataatcttataatcggaaaaaccaaaagactcccctcaaaaactactagaactaataaatgaatcagtaaagttgcagaatacaaaatggatataaaatatccgtaagatgtctatacatctacagtgaacagtctgaaaaagaaatcaagaaagaaatcccacttacaatagctataagaaatatgatgtataaaatacctagtaatcaatttaattaaaaaagtgaaagacttctacaaggacaactataaaacactgatgagaaaaacgtgaagaacacacacagaaaatggacacatattcatgctcataggttggaataattaatgttaaaagtacaatgctacccaaacaatttacagattgaatgcaatccctgtcaaaataccaatgtcattcttcacagaaatagaaaaaaaaaaaaaccctataatttgtatggaaccacgaaaaaccccaaatagccaaagcgcattatcgcttcttgactgaaaactcccggacagttggggctttttcctgcacagagattggccacttcctgcacatcaggagatccccgcggcctgcgggacccgccccgccctcctgcccaggcgcccgctaggtggtgcctggctgggcccgactccgcccgcctccccattcactgggaactaacacccggcgccgct

SEQ ID NO: 216 - DNA, 10000 bp, Homo Sapien
accacctcaacagattaaagcagaaaatgataaacacctcagtaagacgaagaacacctcagtaagacaaagaaaaatcaattaagtaaacttcaagatttattcatcattaaaaaacaaatacaaatacataaacaaaaacaaaacaaaatcccaaaactctacatagaaacagacttccttaacccaaaaagggtataactgtagctaataccatattttttttttcatgttccatgaaattttatttcacaaaggcttggactctgaagacccacagttatggatcattaaatcctgtaagtaaatgtaaatccaaaataaagagttttaacaaaaacataagacggagattttttggtttaaaagaacagaattatttgggagatagctagaactcttccctgaggattcgtttataaaacatgccttagaagttattaggagatggtgacttaaaaaaaaatgtagcaattttatctaaatgactgcaatatcacaccttaatgataaaaagaaatgcattccctttataatcataaacaagataagtatgcttgctgtcaacacttctagtcaacatggtgctggaaatctgagcaaagaaagaaaaaagatataaggattagacagggagggtggtggggggcacggtggctctcgcctgtaatcccaggactttgagaggccgaggctctcaaggatcacttggctaacatggcaaaaccccatctctaaaaaaaatataaaaattagccgggcatggtggtgcacaccagtaatcccagctactcgggaggctgaggcaggagaatcacttgatttcgggaggtggaggttgcagtgagcagagattgcgccactgcactccagcctgggtgacagagcaagaccctttctcaaaaaaaaggattagacagggagaaactagactgtcaccatttgcagatgatatgaatggctatgcagcaaagtccccaaaatctgcaaagtaaattatttaaattaataaggtaatttagatacaaaatcattaagcatcatgtttctgtacataaacaacagtcagaaaatagtaagatttataacaaagttatggctataattatcaagacaggtagtatcagcacaggaatagacaaataggtcaatgggactgagaaaagagccaagaaataaacgtatgcctatatgtataagtaaacttgatttatgatggctcgcattatatcagtaggggaaaggtcctataaatacatgaacctgggacaagtgtttgatatgaaaaaaaatgaaaactggtttcctgcctcacaccatatacaaaccatcaattcctggtagaataaaggcttaaatgtgaaaagcaaaactataaacctttgagaagaaaatataagagattatgtccatgactttagggtacagaagggtttcttagacaagaccacaaggcagtcacaataaacaaaaggatcaagacaaaattttatagataaaattataaacatctgtttattaagataccttttatattgaagctgcatgattacacatgcagacccgttattctattctgcctagcagtgacagaaacaaaccacaaattgaggtatttgacacttacgtaactaaaaaaggtttagcatacaaatatatgtaaagaatataaataagaagcaatctgttaagaaaaaaggccgggcgtggcagctcacgcctgtaatcccaacacttcggtaggccgaggctgatagatcacctgagttcatggcaaaaccctgtctctaccaaaaatacaaaaaattatctgggtgtggtggtgggcgcctgtaataccagctacttgggaggctgaggcaggagaatcgtttgaactcaggaggcagatgttgcagtgagctgagatctcgccattgcactccagcctgggcaacaagagtgaaactccgtctcaaaaacaaagaaagaaaaaagaggccgggtgcggtggctcacgcctgtaatcccagcactttgggaggccgagacgggcggatcacgaggtcaggagatcgagaccatcctggctaacacggtgaaaccccgtctctactaaaaatacaaaaattagccgggcgtggtggcgcgcgcctgtagtcccagctacacgggaggctgaggcaggagaatggcgtgaacccaggaggcggagcttgcagtgagtcgagatcgcgccactgcactccagcccgggcgacagagcgaaactccgcctcaaaaaaaaaaaaaaaaaaaaaagaaaaaagaaagaggtatttcacaaaaagtgaatatttgaaaagatgttttacttctttaatcagagaaaagcaaaatcacaatgaggtgtcatttcatttccctgtaggcagccaaaaattaaaacctaaggcaaaattaagtttcggcaagtttgtggaacaacagaactccaatacactgctggtagaagtgaaaattgctatagaattagaaaatgccgttacaccttggcattatattgtaacaatgaaaagacctataacatactccaggaattctactccttccactaatgcacaaataaggtacacaagaatgtgtagcacccaatcctagtgtttctggaattacccaaatgtcctttgagaagggcactggaaaatgcatcatatgttcacacagttgaatgaataactacaacctcatgcgtcaatgtgactcaatcacaaaacacagcgttatctgaaaaaaaatcaacaatatgaaaacatttctataaagattaaaaacaccattgcacagttgtatcaggaagcagcaaatagagacctccttggcaatagagactatttcttaaattggagtataagttcatagatgctggttgtgcttcatagcttacatgactgctacatagcttacatgtgtgctacgtgtgtgtgtgtgtatacatatatatatatggaataattcataattgtttaaaactagttaaagggggatgttgaatgaaccctacaaaattttaacgttattaccttgaggtttggataatgtaggactttcactttctgtattattcatttctggactatttaaaacttatacaattaagtaaaatgtttgtatttgggtaaaatgattgcacaaaggaaaacaaattgcatagaaatctggcaccatttgagggcaataattactgttttcaacttacataacttctccaggtgtcatatattaaaattatgttttgcggaccgggcgcggtggctcacgcctgtaatcccagcactttgggaggccgaggcgagcggatcacaaggtcaggagatcgagaccatcctggctaacacggtgaaaccccgtctctactaaaaatacaaaaaattagtcaggcacggtggcgggcgcctgtagtcccagctactcaggaggctgaggcaggagaatggcgtgaacctgggaggcagagcttgcagtgagccgagattgcgccactgcactccagcctgagggacagagcgagactccatctcaaaataaataaacaaataaataaataaataaataaaattatgttttgcatagtctgggctgctaactgtattatcttgagaaaaatttccaacaacaatgggtttaaaaatgttggttttactgaaagcatgaatgctttttctgtactgacaattcctggcttcatctaatttacgttatacttatttgcctttggctcacttctgcacttttcccatttttaaaagataaactgtaaactgccacaaatccttttctgctggagcctggaccaggagcgcggattcctgtaaataatgatgtaaataaataagtaaatcaatgactcccattcccaaagggccttcttttccatttttctctggggcatcgaagtgcggtgtgccctgcgagctcccacaggaacaacccggaacgtttgtggtcctgttgggccaccgcgtgctcggtaggaagcggacgtcccgggggctgaaagggccttagcgattttctcgctctagtcccacccgagacccggggcgctgcaggaacctgcccaggccaccgggtgggcggctgggcgggagaagctgggcagcccctggcaacaccgaacggccaggacacacgcggcttcctccgcgggaggcgcttctctctgcgcctgggccttcacgacccctcccgcgaccgtggccccgaggccaggtgcttacttgccgctctccacgccgtggccgagacccagctaagcaaccagggaagcctcgatggggtcatggcgccgactccccgagcctccgcgcaggcgcaaagcagtagtgggaggagcagggggcatgatccggagcctccctgcagagggcggggcctccgtggccggctttagaaaaggagttagaggcatccctgggctctttggccaagagagacccaggctaccttgagcccggtgttaaaacgccaaatcgtggctgcagttagaagagggaataattccgttccgttcatgcttgtcagtctgagccgaaatggcccgtggaagatcccttttatagtttacaaagattgagcaccttttactctctcactcatgtaaaatgcttcttttacctaattctccctgttttgtgttttaaatctttgttcagtcagctcctagttcgtccattctgaccgactaaccagatgatatgaaaggcgacatttttgaatgaggtgcaaagcaagaaaaggctctccatccaggccaggatccagtgcaatgagctctgccccttaacccttacatcccaccagctctgatagcgttgagtggatgtggcagacctggatgctttgtgcaactcgtggaaatatttacagaatcatagtgaaggcccccagaattctggaattttgtcttttcttttaaagaaaagtttctggctagctattgcgccttggtagtgtctgaccatgtgacatcaagtggttatacgatcgaagcttcttatcatgaactgagaattatctggttctcctagataaggagatccttttacgaagagaaagtgggccgggcaaggtggctcactcctgtaatccgaacactttgggaggccgaggcgggtagattacctgaggtcaggagttcgagaccagcctggccaacactctactaaaaatacaaaaattagccgggcgaggtggcacattcctgtaatcccagctacttgggaggctgaggtagaagaatcgcttgaactcgggaggcggagattgcagtgagcagagatcacgccactgcacgccagccttggagacagagcaaaactccatctcaaaaacagaaaaagaaaaaagagagaaagtgggatacacagaactgggccaaagtcaaaacggaaacagttttcatttgtagggagctcacagtcctaatatcatgcttttgacctttagcttatatctacagtttaataatgaattccttgtgactagctgactgaggaaaaaattcaaagtcggatgatggctttgctcaataaactggcccagctggcaactgactgcttttcatatttagagccccacttaacagaggccctgaaggaacagaacagggaaaaaaaattatttccagcatgcataatttagcttatttatgtattttatgtttttacaggcacatgtcaccacacctggctgatttttctatttttagtagagacagggtttcgccatgttgaccaggctggtttcaaactcctggcctcaagggatccacccctctcagcttcccaaagtgctgggattacaggtgtgagccactgtgcctggccagaatttagcttatcttgtatgctttgcctaaaaagagacatggcttgagataaaaatcgacatttcataggcagtgactggtttgtcaagtggctgggaactgggaatgtaaaagttttggactgggtctttggaataggacctctcaaagtggtcccaaagcatgaaaacatttgggtcctattgaacgttaaaaaaaaaaaaaaaaaaaagagcttccattgcagaagggctcttaatcagaacaagattattagttatctattgctgcctcacaaattatcccaaaatttattggcttaaagcaataaacagttattctctcacagtttttgtggatcagtaacctagaagccagagtgactgtggttctgggtcctaaatgaggttgcagccaagctgttggctgaagtcccagtctcgtataaatgcacaactaagggaagatctgcttccaagctcattcacatgattattggcaagatttggttccttgtggactttggactggaaaccttctcagttatttgttaagtgggcttctccaaaggctatcttgcaacatggcagctggctttccacaggacaaatgaactaaggagcaagaaagaccactcaaaatggaagccctgaacttctgtaatctcatttcggtagcgacatcccaccacttccactgtatcctattattaggtcccggccactctcaaaaggggattacacaagggctgcaacagtgacccattctgtggacatcaattactcagcctccttcccccacaacaggtgtggactcagtaacaaggtagccacggtggcaagaatggagacatacatgtacttttaacaccgtctttcttctgccatgactgattggctactaccactactcgccaactgcagtgaccaacttgatcccatgatacacttttatgtggtctgggtggcaggtctgattacaatgaaatcctactgttatgaaggaggttgcaatttgttcttacaggaagagacaattattctgcatttagattgttttccctgatttatgcttattatatacttcacctgtggacttactgaataccttaacacactactccatatttaatacaatatcatatacaacattgcttcttaccgaagaactcattttcttgtgaaagatgtaaagcaggggactaatgcctgcaggattcacagtcttatatattccatcatccaaaagcaaccgattttatggaatgacggacagccttattgaaggttgttttggaacgaggtgagaaaatacactttgggatactgccctaaaggatttgtcatattttccaaatgagtcaacggtatttggtgatatatcttctgttgacagaataacagagatcaaagagtagaaaagggtctgacttcttactattgcatatgacttactgatataaaatatattttgctttccattgtagtagagaagagacaagctccgaaggcccctgaacatgcctgtatattattactgagtgtgccagactgcaagccgtatccatctcctgatgctaagcagtttctgtagttagtcatataggcacctaagtaggtcaaggcaatcacagcattactaccatttaactgctgctccctgggggagagagactagcttgtttgttgtttgctcaaaaactgcttgattcttgatcctggattcttctgtaatgcaaccccccatgtgcacagacgtcatccggccctctgcatcacactgtgggaattgggctacgggaactgatgcaaatatgcggacactctggcttctattttgctgtaataaagctgttttgtcttttgtccaggagtatcctgtcatcatccatgaaactgcagcaacctagcctgtaaccttgcaagtaggataaaatctcagacccttcactactcttgctagccatctctgagtccaggttctgttggtatagcaatttttgtgcccagctggaattgccacccagccattttgacctcattcctctaggtaaggttagagaaagtggtgatggtgctagctggagtgattggccctgatgaccatggagaaaagagagtagggagaacagtataaccagaagtcaggggggtctcctggaatccctcctcacaataccatgtttttatattttattttaaaaaataccatgctgaatggtaacatttacatataagactattacaaccatatataggcaagaccacccacacctcagatcctctgtcatccactggatacataaatctgatcagcagaggtgctgcttgaacataaagaaaacagaaaatagttggcagtggtgagaagtcataaccatctagattcacgaccactgacaggactaagtactgtatttgcgacgtgttattagagaaatttgggacataaaacatgctgctgcttttacactatcctgaaaattctgattcaggtggtccgtaataaggtcctagaatgtgtatttttaaagtagtctaggtaattcttggcacggacattgcaaagccctgctctattttgttttcttcctcactggctcatgcatgtttataaaattttctcttatttcatatgtatatatatatttgagttggggggtctccctgtcgcccaggctgaagtgcagtaactcactgcaaccttgaactcctggactcaagtgatcctcccacctcagtcttccaagtagctgggactacaggtgcatgccaccaggctcacttaaattattttctagagatggggtcttgctatgttgcccaggctggtcttgaattcctagctcaagtgatcctctcacctcagcctcccaaagtgctgggattacagtcataagccaccacgcccagcttctttcctattatactgttattatgtataggggtggtggttaggtcacaattttgtctatgagttgcacactattgagatgagattattacagaatcagagaacatcacactgaggtcctggacttaaaactggatgagggatagtagtactatgtcagaaagatgcattttaaatgtgtaaatatggagagaattatgcttgcagatgttgggaagacaaaaagatggactatattacacctgatgtgtttttatatttggtgctgtcatcaaacccatttcatatgtttggttaaccttggtagaataaagggtcccattttctactgtggaaactaacgaggtcagatacatctgctgtctttgatgcctgacagcccaagcactggcacaagacttaaacttggtcagttggacattctactacgctttgaatctgaagtgataaaacaagtacttgaaatccagtttccagggtcatcctggctagagaagaatacagtcatttagctctgaggtcatcagaacttggctatgcttttggtcatctactttcctttggcttctatttgttttccaaacctggctctctagcctttccatcaattctgtgagctacctgatcctcctccaataaattctttttctgtttaggttgatcataattttttttgttgtttgcaaccaagaactcttactggtatacttcaatgagattcattctctaaagtaagagtcaataataccatttcagatcatcgtttcctctctcccccataactgtaccccatctcccacaatctgaatttggaggtgaatagtgtgtggtggtttcccagataaatcaagtaagttaaatttgttagattttaaaccatgaacacagatgtgcttttagaactgtattaaaataaccaaaaactaatcaatcaactatgataagagcaatttccactcaaatactatttatatgattgagtcctttgataaacctgaaaattatccaaactttgaatatgcacatttcaaactcagagccaagatataggaatataaaaaatgtgcttggcaaaaatatgtggtggctaattaatatatttacattttctagttataatgcacttgggatattagtttataaaaattttgagtactttctaaaaagtaaataattatcaatagcaatcaaaattattttaactataataatatatacaaaagatataaaaatacaaaggctacaagttatataattagg

SEQ ID NO: 217 - DNA, 10000 bp, Homo Sapien
agcccacagccctggtgctgtgggacaccctagcaggattctgttgatggcagctttgcctcctccctaaggatcctgcccagccctccctctgcccctgcttctgccctcacctgacctcccctcctctgccggcagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaaccttgtaaaaaccatgtggggtaaactgggaataacatgaaaagatttctgtgggggtggggtgggggagtggtgggaatcattcctgcttaatggtaactgacaagtgttaccctgagccccgcaggccaacccatccccagttgagccttatagggtcagtagctctccacatgaagtcctgtcactcaccactgtgcaggagagggaggtggtcatagagtcagggatctatggcccttggcccagccccacccccttccctttaatcctgccactgtcatatgctacctttcctatctcttccctcatcatcttgttgtgggcatgaggaggtggtgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttatctgtatttcctaatttttctacaatgaagatgaattccttgtataaaaataagaaaagaaattaatcttgaggtaagcagagcagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagacgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaacaaatgcatttgttttattattgcaattttctccaatattttttattttctttctcacaatgaacaactatccttcatttacccaaatattctatttaaaagctaataatacagcatttgttgagtcatctggttctgcaagattgagatcctcttgtcctatgtgccaggaatgaactccagtgtccccacccaaaccctggggaatgggagcagaagccagaggaggagcccatatctgagccccaggtattccacctgcacttcacctgttggaccagcttggtggttgagagtccactgaggcactggcaaggaggtggccaggacagacaaggctgcctctatggacctcacagctccagcccagattcagctgaagtcctcaggcaacaggcagcacagctcctaccccaggcctctcagggctgccaagaacatgagctccggatgctaggctgtgtttcagaccctgttcacactctctttgtccatgggcccagacacagtcttgtgctgctccctctgcttttgggtcctccatccatcctctctgcctagataaatctctcatctttcaataccctgctaagatgtcacctcctccaagaagcttttactgagttgagacacccccagctatctgatctggcaatgtttgtatgcacctccctgcactgtagtaccttaacttggagtctgtggcccctgggatgaccttaaggttagggacatataagtttgtctcttagcaccttgcataatgcttggcacataatggaaacccaatgagtatataatgtagaaactatttctccaccctggaatattctctccttctcctccacccatctaaacaggcccacctctaagggagcagcttaaattccacctcattcttgaaggtttctccagcctgaatttgttgcttcctcatttgtaggatgacagaactcagaagagctttagccatgatgagccgacacaagtcagtagtaaaagaaggaatataaaatgcctccttcaggaatgtacaggctggacatcatgactctacaagtgaaaaagagttagtggctttagatttctgcaattttggtataaatcactggcctggacctgtatttacagagatgcaatactcacatcatgtggggtttgtacaaattgcagacatcgaggaacagagaatgttccaagggcaggctgtagggaagaggctacgatgtgggaggtattatcctgaaaaaagcaatgcacagggagccctcttcaagcacttaaaggcttgccaagtagaagaatgtgcttgttctgtgtaattccagaacacacaagcagaaccaatgggtgcaaattatgtggaggctgtttttcctatatgacccccatattttaaccacaaggaccacaaacattgatagggtttcttcaagaggttgtgtggtccctgaccctggagatgttaaggcagagcctaattaaccaatttctcagggatgccatagcacagatttctccaattggagggaaactatgattccatgtctatgagatggagtttcactctgtcgcccaggctggagtacagtggtgccatcttggcccactgcaacctctgcctcccaggttccagtgattcccctgcctcagcctcctaagtagctgggcctacaggtgcatgccaccatgcctggctaatttttctatttttagtagacacgaggtttcaccatgttggccaggctggtttgaactcctgacctcaagggatctgcctgccttagcctcccaaagtgttgggatacaggcatgagccaccatgcctggcctaaagtcctttcaattctaagattttttttttgcccaaggagcttatctgccactattgtttccaacatgtccttggcccacagcttagagagtctggtcttcttaattatcttttcaagtgtttatgacttagttcctcagctagactgtgaaactacttaacaacaaggactgtgtattgaatgtctgtgtcacacagcagtgtaaatgctgggtaaacactcattggttgcctgacatagtaactcatgctttaagccttcccatagaagggtgagagattgggagagtggaagaagaatgatcactggccttagaaagcagaaatctggtcccatttctgcccatcttttctcatttctcatcctgcaggcatctgagtcttagacccacctatcccacttcctcaagaagcccttggtggaactttgcaaatgaccaaagagggagaattataataaggttgttagtttccagagaacattacacctaagcttctccacgcttgtaatggagggatggatggatggatggatggatggatggatgaatggatggatgaaagggtggacagaagggtggatggatgggcacatgggtggatggatggttggatggatgatggatggatggaagaatggacagatgggtagatagatggacagatgggtggccgggtggatggatggatggatggactgagtcaagtaatgtcaattagagacctgagtgttctttcctctgtgctctactcacactatcatatttcctagcagtccatggcacatgatgtctgctcagtctcagggtgaatctgaggtcaatatctttgcagttgggtttccctagatgttctgtcccatcaagctggtaccaactaattaaacccactgaaaagcagagactcccttctcgtctttccaaacagagtcacactcacagtgctatcagccccttctcttattctggctgtctggccacagcctggattccggcatcagaatttgttctgtccttgggcttgccagacatactttctcttgtattcaccacctcttcaagcctaggatggagccccacggggcaccaaagatgtctgaccccagcactgtttatctggctgcaaacccactaataacatagtcaacgacagtcagtacagagcaggggccccataccttatttctgccaaggctttatggatgactctctcccccttcaacaaatgctcattaatgttcccaccatcttattattcatgctgtaccaaagacattgtgaaatgcccaggctcttcttccttcatgtcctgcagccaattatagagattggtgcaggcctgacccacctgtaccagacggtataaacacagcgcaatgccctggagaaatcagttggagtctccagggatcagggttccaggaactcaggatctgcaggtcagtgatggacaggcaatattctctctctcttttctttcttttctactctctcctgtcaatatctctggtatgccctctatcccttcactcctcctggcaagctgtctaggtaacaaggtagtcccctcatatgacatgatgggacatcaaaaacatttaggagcacataaagagatttgaggagaaggaataggttaagccaaatcaagatttctgaactacttagaacaactgactttagaaagtaatctcaaaagaaaccatctgggccaatggtattcaaaccgtgtttggtggaagcttaagagattttttgttttcgtttttttttttttgtgctccttggtagctcctcagtgtcttctttgcaggcaagagaaatactagcagggttccaaagtctccattgcttcctgtgtcagcaaagcagctgccctttatcctttttacaatcattagaattctgcataaaattttattgtgaaacttaaaacagttttgaaagataccttactcaatctttccatccaatgttgataagttgaaggcccagggataaaaggtggcaaaataaattggtagcagagctaggtctaggactcagcctttctattcaaagtctgctctgtgtgtttctatgtcctggccacaaggaccagggtagttcaattagggtggttggagagagcttcaagtgagctgtaagccatgcttcatgacttcaagatcttataaacttttataagggaaacaaatatctttatgtacaacaataaataatacagtaaaatttaataggagttcagagtagagttacaatagtaagggaaagattcattaaactctgagtcatggaattataaatagtttggcctagaaagaaccttcataaccacataatctaatcccatgaatgtatagtgctgaaactgagggttggaggttaaaagacataaccctgtatgtctaagctgtaactctacactggtaattaatttgatagaactagatactgaacccatctatactgatactatctccagtgatcttaatatcaaaagatctgaatggatgacaatgagaagggatgacttttgaggcagggagaacaatgggacacctgtgagtacgtccactgagaagataagaaaggaattatgtcgccaggaggtgtggtttagtgtccatggagaagtgagatgctatcacacaagaaaatcagtgccagacggtgacaaaacagtcagtcactgtagattctagagctgggcagggatgtggtgaaaaaatctttagaacgtgggtccacattcctcacataggttggaatgaatgaaaggcagaaaaaccgggaatacaagtacagtagtaatggcaattaaaaacacaaagttatattttaaagaaataacctgtagggacttgataagttagacactgagtcaggagaagtaggagatattgtcaatgagtctcaggttttgaatatcactggtgagaggaatattatgacagtgagagaaatgaaattgggaggaatgtgtgggctgggaggagaagataattaacttaaccttaaatatatttggttggatatcagcaggatgtccaaagtgggctgtcctgtaggctgcaggaggtaaagtgggatgtgcagtctacatttgggagccattagcccaagataatcattgcagctgtagaagtcaatgaattgcagcttaatatgatgtgaaatagaagtgcttaggaccttgttagccttaggggtggccccagaaggaggtgaaatctacaatgggagaaagaggtgtgaagggagtcattcaatgtcaagggttccaaggaggcaatgactaaatatcaaaggaatcaaaagaatctctggatcttgctccacagaagttaatattggtcttggacagaacatcccacatagatactgtgcaggagaatgatgaaggataggacagggtgctgtgcaaaagaacatggggaaagcccaagtttagctgatggcagtgtttgagccaggacaggtgaattgcggaggtctgagagccagatgccatgtccagggagaaatgagaggaagaaaagagggatatagactgaagttcagtgaaaagtcatttgaggaaaatagggaggggaagctttgggggtgaggcatgtggcacactgggaggggcttggcacacagcagaggttcagcaccaagacccaggctctctgatggaccagacgctagcttcctacccttactcacttcatcacaatctatcagaacccaggcggagggagccgaataggggagcctttgggaaagacactgtacattttggctgtgccagaatgggaggtttctagggcccatgggatccagctggactggaccagcattgaatttcttccagctctttgagctgacactgacccagagtgggagtcatcagcttgctatccaccttcacccagggccctccactttgttgccccacctagatctgggcacagctaccacactgcccactgtcctgctgctacaaccaaagaagccccagtggtttggccaaggggagcccatcatcaagtgggcttgcattgaggccatgatgctgttgagttatctgtactgggggattgtctagtcctttaggactcaaagtgctggccaggaggaaccagcagcattgacatcacctggttgcatatttgaaatgtacagtctcaggccccaccccaggcctgaaaaaccagaatctgttattttaacaagaactgcaggtggtttatatatttattaataagtgtgaagaatggaatgaaagtacaccagttcccaagcagcatggctgattgctggaatcactccaagtcctactgaattagaaccttcggcccaggaaatagtaattatacagagtcccccaggtgatgcagatgggcaggcacatttaggagccaatgactttaactgaacacttcatttaaaaaatgttgaaacttacttgatactacaaaggaaattcatgttcattataggaaaatgttgatatgtttaaaaaattactcataaagccataggtaagtggtgcaacaacacgagtaacatttctatgtatgtgtctctatgtgtggatttaaatagaattacagtgtacacttgatttataatctgcatttttcacctaatatattttgaaaatttttatgtcctaaaacaagcttctataatatcatctttaacaaacacatacatccttatttattgaattttgctataatttcttagccaattacctattactgaaaattcagatttttttcaacttcttgctattgtaaaaaattatgcagtgaacatttttgtaagtaaacatttgggcaatccgttatttttcctaagagtaagggaaacacatgcaatcacaaagtatacagaatgctttaagactttcattcacagcaccaacatccctccagaatttgcacttgttagtccctattatccttcactctaagtctcaaagtcataccccaaggcctggggacagaaaatgacttgtccaaagtgacagtgacagacccagtactaaaagccaccttggctacagccctgtttctggaacttgagagctgaggtggttggaagccgtatcctcagcacccacctgttccttctcacctgcctccccagggtccctcagcatctctctattcctccctgagccctattactttcttccacctgccttcttcctttctcttctctcattttctgctttcttatattttttcttctctattcccttcttatttggtgagaatcagatctactcggtaaacctcagccctagtcatacttgcgttactttcctgagctaatttccaactcctgattagctctgggtttatttccatgctaaattctggactggcctttccaatgggtgttcattttagggaagagctctaggacaggataacccatcgggaaggagcagagtcatgtgaggctgtgtggcctggcatttatacagggccactatcttcactgtgccattttccatctggaacagaatgggggagtttggatgggctgttttcggcagtcttggccaagcacttctagtcactaggaatgatgttttccaactctctggggagaccccaccagcctcactgctgctggagaccccttctagttgtgctctcttctttcactctgggctctagttatctaacccttggctagttatgggggcgggggtgtggtgccctgttggccaaca

SEQ ID NO: 218 - DNA, 10000 bp, Homo Sapien
atcaagggaacagaagtgagggcacagaaatcgagccacacaaatatagaaaacagattttttacaaaggaccaaaggaagaagaagaaagaagaaggagaaaaagaagaagaaggagaagaagaggaggaagaggaagaagacgacgaaggaggaggaggaggaaagaagaaagaagaaaagagagaggaggatgagaagaaaccaaacccagacctcacataatttacaaaaattaactcaaaatggatcatagacctaaatgtaaaaagtaaaactataaagcttctagaagaaaacataaaagaaaatctaggtgaccttgggcctaattatacatttttgggttttttttgtttgtttgttttgttgttgttgttgttgttgttttttgagacggagtctagctctgttgcccagctggagtgcagtggtgcgatctcggctcgctgcaaactccgcctcctgggttgaagtgattctcctgcttcagcctcccgagtagctgggattacaggtgcccgccaccacacccagctaatttttgtatttttagtagaaatggggtttcaccaggttgaccaggctggtctcgaactcctggccttaggtgatccacccacctcggcctcccaaagtgctgggattacaagcatgagccactgcatccggcctcaatttttttttttttttttgagacagagtctcactctgtcgcccaggctggagtgcagtgacgcgatctcggctcactgcaagctccgcctcctgggttcatgccattttcctgcctcagcctccctagtagctgggactacaggcacctgccaccacgcctggctaattttttgtatttttagtagagatggggtttcattgtgttagccaggatggtctcgacctcatgacctggtgatccgccctcctcggcctcccaaagtgctgagattacaggcatgagccaccacacccggccaatttttgtattttttttttttagtagagatgagggttcaccatgttgggcaggatggtctcgatctctcgacctcatgatccgctgacctcagcctcccaaagtgctgggattacaggcctgagccaccatgcccagccctgatatatatatatatagatagatagatagatagatagatagatagatagatagatagatgtaattttgagacagagtttaactcttgttgcccaggctggagtgcaatggcgcaatgtcctgctcactgcaacctccacttccggggttcaagtgattctcctgcctcagcctcccgagtagctgggattacaggcatgcgccaccacccccagctaattttgtattttttttagtagagaagaagtttccccatgttggtcaggctggtttcacacccccaacctcaggtgatctgcctgccttggcctcccaaagtgctgggattacaggtgtgagccaccacgcccagactcctgatattttttttattttattttttttgactcctgatatttttaattaaaaaaaaaattaggaggtcagggaacccaatatggaaggcagattgtggcaaaagaatttaatgatactactaatgtatgaaataacttttctgaagggagctgggggaaaggtgctgacctgagtaattttggaaatgagtcgagtctgtaagatcaaaggcaaatggaactacacataagcactgtaccctagtttataagattgttctccacaggggtatgtgttaacaattctcttttgagacattatgattacaaataaagaaatattttattttattttattgaaacggaatcttgctctgtaacctaggctggagtgcaacgacgcgatcttggctcacagcaacctccgcctcccaggttcaagtaattctcgtgcctcagcctcccaagtagctgggactacaggtgcgtgccaccacgcccagctaatttctgtatttttagtagagacggggttttgccatgctgcccaggatcgtcttgaactcctgacctcaggtgatccacctgcctcagcctcccgaactgctgggattacaggcatgagctacttgcctggcacatataaagaaaaattttaggctgggtgtggtggctcacccctgtaatcctagcactttgggaggccgaggcaggtggatcacctgaggtcgggagttcgcaaaccagcctgaccaacatggagaaaccctgtttctactaaaaatacaaaattagccaggcgtggtggcgcatgcctgtaatctcagctacttgggaggctgaagcaggagaatcgcttgaacccgggaggcagaggttgcagtatgccaagatcatgccattgtgctccagcctgggcgacaacagcaaaactccatctcaaaaaaaaaaagaaagaaagaagaaaaagtttaggccgggtgcagtggctcatgcctgtaataccagcactttgggaggccaaggcgggaggatcacctgaggtcaggagttcgagaccagcctggctaacatggtgaaaccctgtttctactaaaaatacaaaaacaaattagccaggtgtggtggttcgtgcttgtaattccagctactcaggaggctgaggcaggagaatcgcttgaacctgagaggtgaaggttgcagtgaactgagattgcaacattgcactctagcatgggcaacaagaacaaaactccgtctcaaataataataataataataataataaagaatttaaaaagaaaaacaaaacaattctgatactcctatacacgtgtcctggaataaacaattaagtaaatagatggcaaattatggaagccaggtttctcacagttggggtgggagtttagataaacaagggaggtggctagaatgatccatgtagtaatggattaaagttggagacatcagtatgaattcatgcttagcttaatatagatatggatggttatatatggaaatacatgtttgtgtatatacgtgggttagtatacacacatatatttccttgctttctcagatgtgagggtccagaagcaatgatacctcaaaagcaacaagcacacctagggcccagatcttggattctaaaaccatttgccaataaaagaaaataggggtccttggagaaatggctgattgcaggactgtggcaggaaatacacaaaatgagcctggagcattttatagtaccagaaagtaaggtgacactaaataaaaacaaggttttaattaaaataccaatgatgacaacaacactgatgggactcttatttttctccctggttgaggattgaccgccatcatgaatgacttagtaactatctgaactaggaagttcatgatcaactgactacatacttcaggaggaacaaatggttattgaggtccttcaccctgggaagacaacagtacctaagacagaaattcaggaaaaactagccaaaatgtatgagactacactagatgtcatcatctttgtttgtttttgtttgtctttatgagatggagtctccgtctgtcacccaggctggagtgtagtggcgcaatctcggctcactgcaacctctgcctcctgggttcaagtgattctcctgcctcagcctcccgagtagctgggattacaggtgcctgccaccacacccggctaatttttgtagttttagcagagacagggtttcacaatgttggccaggctggtctcaaactcctgacctcatgtgatctgcctgcctctgcctcccaaagtgctgggattacaggcgtgagccaccacgcctggcctcatctttgtatttggattcagaactcattttggtggtggcaagacaactggctttggcatgatttatgattcactggattatgcaaagaaaaataaacccaaatgctgacttccaagacatggcctggatgagaagaaaagaactcaagaaagcaatgaaaggaacacaagaccagaatgaagaaagggggactgcaaaggacagtgttggtgtggcaaaaagccaaaggagtaaagatgctacagtaacatctgtggccactgtggatttttcacaagatttataaactaaaaacttttgtgtgcaaaaaaaaatggatgggggtatgctaaagagacacaggagccaacggaaacagctctcaaaggccaaagctagaacgaaattagctagaaaataaatatgaagtatattggattataacccaaagtataaatgtccatgagtccatactgattaaataaatggttgaataaataatggaggagtagagacaaatatctcatatgaaagaactccaggccagggatggtggctcacgcctgtaatcccagcactttgggaggctgaggcgggtggatcacgaggtcaggagatcgagaccatcctggctaacacggtggtctctattaaaaatacaaaaaataagccgggcgtggtggcgggcacctgtagtcccagctacttgggaggctgaggcaggagaatggcgtgaacccgggaggcggagctctcagtgagctaagatcgcgccactgcactccagcctgggcgacagagcgagactccgtctcaaaaaaaataaaaaataaaaataaagagcctaaggactaaggatttaattaaccaagcaccaacccgtgcagcctcaggagactggtcccgcagcgcaagtgtgtccctctaccccccgcaagccgggccgcgtcttcctggctctcctggcgccggcaccgagcagggcgtggacctgaacttatgtgaccccacccggtcacaacccggggtaggaagctaaagccgtccgcccacccgaggggcggtcccagcaccccagtgggggactgctgcgctcggcctctgtgttcgatcgggaacccaggtctcttccctgccaataacaaaaccgccgcgtcccgggcctcccttccggagccggagtcggcggccgagcgctggtggcggagcctggacagttaattccaaccgcctccgggtgattccggggacaggagcgccgagagctcctccctttggccgcggagccggctcggcgctgattggctgagggcctcggttgtggctcttgaaggctccccattggccccgcgctccagtggcaggagtgtggcggcccggcctccgcaggctacccggggttgaagctactgcgagctccggtggctgcctggggacgctcagggacgctcattcctggccagagtcctgacttctttctcggatcgagatctcgttgctggctcgaggaaatcaccggctcttctcccggatccttttcttctctcacttgctggctttcttcttcctgcctccctggcttccatctcccaaccccgcgattccctcctctactcccgtgctcccgtcgcccgccatcctgagccatcccacctgcaaccttctgtcttttgcccctccttgacctcagagggtcctgccttaagcttctcaccagaatctcctagatttctatctcttccctgcttgccagctcttgactcccaaattccagctgacgtttgaccacttgacatttgaccctgacacccttgactgcaaatctaaattcttatcttctgcaacctgtactgctgaaacaggccttccccctgtcttccaaccccgctttctgacacccatttttactttcttactcttgggtcagttcctgctacagctatcccaccatggacttcttgatgagtggcctggcagcctgcggggcctgtgtattcaccaatcccctggaggtggtgaagaccaggatgcagttgcaaggagaactgcaggcccctggcacataccagcggcactaccgaaatgtcttccatgccttcatcaccatcggcaaggtggatggccttgctgccctgcagaaaggcctggcccccgccctcttgtaccagttcctgatgaatggcatccgactgggcacctatgggctggctgaggctgggggctacctgcacacagccgaaggcacccacagtcctgcccgcagcgcagcagctggggccatggctggggtcatgggagcctacttggggagccccatctacatggtaagaagagggctcttgcctgggaccttcagggcagatcctcgttgtaggataggagctgttctttcccaagggcataggtggcagggtgctgccccactgcaagcagggaaaggcatcaggaaagtgctggtaggcttcggagtcttctgatctgccctatacacacccatctgatggacacgattgaatgtattgattaagattatgggctttggggccgggtgcagtggttcacacctgtaatcccagcactttgggaggccaaggcgggcggatcacgaggtcaggagatggagaccatcctggctaacacagtgaaaccccgtctctactaaaaatacaaaaaattagccgggtgcggtggtgggcgcctgtagtcccagctactcgggaggctgaggcaggagaatggcatgaacccgggaggcggagcttgcagtgagccgagatccggtcactgcactccagcctgggccacagagcaaggctacgtctcacaaaaaaaaaaaaaaagattatgggctttggaatcagactttctggaactaaaatcctggctttgaaaattactagttgttggccgggcgcggtggctcacgccagtaatcccagcactttgggaggccgaggcgggcggatcacgaggtcaggagatggagaccatcctggctaacacggtgaaaccccgtctctactaaaaatacaaaaaattagccgggcgtggtggtgggcgcctgtagtcccagctactccggaggctgaggcaggagaatggcctaaacccaggaggcggagcttgcagtgagctgagatccggccactgcactccagcctgggccagagagagagactccgtctcaaaaaaaaaaaaaaaagaaaagaaagaaaattactagttgttgagcttcagttgccacatctgtaaaatggtgataattatagtgccctttctgtgtgattattgggaggatcgagggagacaaatgcggtagacatgaaagcattagtgcgaatcctggcagacagtaagcatttggtagcatttgtttttattattatgtgttgatattgaggttggatttgtgaaggggaggataaggaatttaacatacgtcagagagtctagggatcaggaaggccctgggcatcacagaattaacaatctcaacatctgcccctttgagttatctggtataggtgaagggtcaagagcctgaggcccagaaaggggaagtgacccactcaaggtcacacagctgtttattgctaggactaggccctgcttagtgctcccaagagcaaaagagacggggaagtagtatgtcctgtagcagaggcagtctggtctcatttcaaggtgtgagtttcagggacagtggtctccccaaagtcagctcgatacctctgtgggggttgggggctagagagcaagttttgcccagagtctgatggggagcctgatagaagtggtggctggagatccagtctgggaatgggagctagcatgagaggcgggacaccaggtcttgcctaacatgaacagccttaggaaatattgccattctccaaccactccacccccgactgctagccccaagggaaagaggatatgaaggggttggggtgtcttgcagtgctgggagatccacccccctggggctggagcctagagacagagtctttttgttaaccagtttgttaagtaggaagaacaataatcagagtaagaggctattcattgctgaacaccctagaggaagtgtgagggggtgagacatttggttctcaggtaggaggatggccactggggcacaggctatgatattctcttgttcccaggtgaagacacacctgcaggcacaggcagcctcagaaattgctgtagggcaccagtataagcatcaggtgagggttcccaagtctgccaaagtccctgaccatcctttctcttttcccctagctttctgcctgcacccaacagatccaatcccagccactgctctgctcaacccatcggttctgtcccattttgcccctggagtctacccagaccctctttactctttttttagatggagtctcgctctgttgcccaggctgaagtgcattggcacgatctcggctcactgcaacctccgcttcccgggttcaagtgattctcctgcctcagcctcccgagtagcttgggactacaggcgtgcaccaccacacccagctaaattttttttgttttgttttgttttgttgagacagagtcttgctctgttgcccaggctggagtgcagtggcgcagtcttggctcactgcaacctccacctcccgggttcaagtgattctcctgctgcaacctcttgagtagctgggattacagccatgcgccaccacgtccagctaatttttgtaattttagtagagatggggtttcaccatgttggtcaggctggtctcgaactcctgaacttgtgatccgcccgcctcggcctcccaaagtgctgggattacaggcatgagccactgcacccggcaatttttgtatttttaatagagatggggtttcaccatgttggccaagctggtctcaaactcctgacctcaggtgatccacccgcctgggcctcccaaagtgctaggattacaggcgtgagccaccgtgcctgatgcctctttccaatatgtactccagttcctctaattttctgcccctgtttctcctgaccagtgaatggcctcacttgcatacatcccgccccagttcttgggtgcccagggaaggaacaatggggtggctagacaaccaagggcccacattctggctctaagcccacattgaactggttgtctggacaagagattcctattaaggacccatccttggcagtgttaggatggcagcccctgatgctgggctgtctgaaccccacccccggtcttccccacactagggcatgtttcaggcgctaaccgagattggccagaaacatggtctggtggggttatggcgtggggctctgggcggcctgccccgagttatcgtcggttcctccacccagctgtgcaccttctcatccaccaaggacctcctgagccagtgggaggtactgcctgggaaatgggtgggtctgtttcgggaaggggggaaggggagggcaagctgcactaggccctggaggggatggtgcccaacattcacaggtgagggagtggcaggagggcttggaggtcaactctttagacccttcccacagttctcttgtcacttcctcccagaaggggtacctgagccttcagggtaccctggccttcctccttctcactgtttttgcactgttataactggtgcagtggaagctcccccagttaccagcatctgtgtccccagggcagggactgtcctgtccttggggtgtaatagttggctggttgacagtgctcttcctctctacccccttagatctttcctccccagagctggaagttggcgctggtggctgccatgatgagtggcattgcagttgtcttggccatggcaccctttgatgtggcctgcacaaggctctacaaccagcccacagatgcacagggcaaggtaaggaagtgctctgggatgcaggcgggaagcaggggatggggaaggcagattgcgggtgcaggtgggatagcctgaaatgcagcctgtagaggtgctgcccctggtgggctctgacaaactccttctctgtgctctccctccctctctgacacactctcagggcctcatgtaccgggggatactggacgctctgctgcagacagctcggaccgagggcatttttggcatgtacaagggtataggtgcctcctacttccgcctcggcccccacaccatcctctccctcttcttctgggaccagctgc

SEQ ID NO: 219 - DNA, 10000 bp, Homo Sapien
  misc_feature 5923, 5924, 5925, 5926, 5927, 5928, 5929, 5930, 5931, 5932,5933, 5934, 5935, 5936, 5937, 5938, 5939, 5940, 5941, 5942,5943, 5944, 5945, 5946, 5947, 5948, 5949, 5950, 5951, 5952,5953, 5954, 5955, 5956, 5957, 5958, 5959, 5960, 5961: n = A,T,C or G
  misc_feature 5962, 5963, 5964, 5965, 5966, 5967, 5968, 5969, 5970, 5971,5972, 5973, 5974, 5975, 5976, 5977, 5978, 5979, 5980, 5981,5982, 5983, 5984, 5985, 5986, 5987, 5988, 5989, 5990, 5991,5992, 5993, 5994, 5995, 5996, 5997, 5998, 5999, 6000: n = A,T,C or G
  misc_feature 6001, 6002, 6003, 6004, 6005, 6006, 6007, 6008, 6009, 6010,6011, 6012, 6013, 6014, 6015, 6016, 6017, 6018, 6019, 6020,6021, 6022, 6023, 6024, 6025, 6026, 6027, 6028, 6029, 6030,6031, 6032, 6033, 6034, 6035, 6036, 6037, 6038, 6039: n = A,T,C or G
  misc_feature 6040, 6041, 6042, 6043, 6044, 6045, 6046, 6047, 6048, 6049,6050, 6051, 6052, 6053, 6054, 6055, 6056, 6057, 6058, 6059,6060, 6061, 6062, 6063, 6064, 6065, 6066, 6067, 6068, 6069,6070, 6071, 6072, 6073, 6074, 6075, 6076, 6077, 6078: n = A,T,C or G
  misc_feature 6079, 6080, 6081, 6082, 6083, 6084, 6085, 6086, 6087, 6088,6089, 6090, 6091, 6092, 6093, 6094, 6095, 6096, 6097, 6098,6099, 6100, 6101, 6102, 6103, 6104, 6105, 6106, 6107, 6108,6109, 6110, 6111, 6112, 6113, 6114, 6115, 6116, 6117: n = A,T,C or G
  misc_feature 6118, 6119, 6120, 6121, 6122, 6123, 6124, 6125, 6126, 6127,6128, 6129, 6130, 6131, 6132, 6133, 6134, 6135, 6136, 6137,6138, 6139, 6140, 6141, 6142, 6143, 6144, 6145, 6146, 6147,6148, 6149, 6150, 6151, 6152, 6153, 6154, 6155, 6156: n = A,T,C or G
gcttatgtggtcagcttccatggacccaatgcccccactaaacatgatgggcttgatccactcacgccgctggccgtctgggagctggaggcccaaggagcgggcgaagcctggagtgtgaacatcagagggacctgtcactcagttcccccagtgctcgcccaatagcacagcccctgggtcgcacaccccacccacaagcccctctgggtgtttgtcatccctccacaccccagcctcaccagccagcactggttccccaaacttgttgccatagtcagaagctccattactggcttcaatggcaacctccaggggccgggcaaaattcccaggatactggaagcttagatcctcccagggcagattgtaacctgggagggaaggagagagaactggatgaactgaatgaactgtgaagacaggccggagcagcctgcatccttcaggaagagtcaaggccaccaaggaccacctgcatggttgcaatgttccacttcaggaagtcctgctttaggaagccctagagcctgcagtgaggcactggtcttctttccaccacccacaccagccttccctctgaatctcgcaatcagagttacacaggctttctgtttttttttttgagatggagtctcgctctatcacccaggctagcgtgcagtggcgtgatcttggctcactgaaagctccgcctcccgggttcacgccattctctcgcctcagcctcctgagtagctgggactataggcgcccgccaccacgcccagctaattttttgtatttttagtagagacggggtttcaccgtgttagccaggatggttttgatctcctgaccttgtgatccgcccacctcagcctcccaaagtgctgggattacaggcgtgagccaccgcgcccagccaagtttctcaggctaagaaaccagatttgaggggcaggtactgatcataagaccaacccaatatcatgctttctggctgaatgaaggctagtttttaaagaaaatcgtagacctgcaaaagcagtctggccacctcatctccccaggtctacacttatgaccatagttagtgaaaggccagctatcctagagcccttcctcctgagaaaaggcacacaggataaccctatggacctaacagatagaagtttgctgcctgccaggacaaggaatctggaagggaaggtggatagagaggaaggagatggaacctggaatatgcagatttccaaagcaatagccggcagtgccagccaccacgtgggccccgcggcctgtgcactggacatctcgaatccggccccctgtgccagtggttgcaccactaaaggggcatactcctgcaaagagagagtggggagaggtctgggtgcctcagagacaaacccccatctctgaccacccccactgaaaataaggacaaccaatttccctgattattttccccaggcccactccaggggcctgggacctttgccctaccctattctgtgatctcacctatttctccagggaacccagctcacctgtgggaaagttgtgagtctctgctgtgaagacaacatgtctcagcccttgctgttgctggaagcggcttggccgtgtggggtcctcaggccgtaggaatcggacttcctttccctggattgcactgtggacatacccgtcatggaccttgcttcctttctgggacctacactaacccaaccagggcctggggcctcccctccccgggtcctgacgccaacccagtctagggcacagcacctgctgttatcacagaatttgaggacgttgttggggttcgaggattcctgggtgctcatgatggactcaaacagtgagtgcaccagcttctgcccatccacgtggagctggcccttgaagaaccagtgtcggctgtgctcgctgcagggggcgatgcagggaggggaaggcaggtggaaacggggtcatttcttaatgccatgtcttctcaccagcatttaacagcagagttacagccaaattcatacttagatgacagatcaaaatatattccaaaaagtcataatcttcaagtattctgtcattttggactatccagagccaaagtgaagataaaaccaagatttgaatgtagactccttgatggatgacgggagcccaggccctcagagactcagggaggcccctaagccaagggaggaacatgaaggtgagcccctgtggtctctcccaacacccatgggctcaggtatgggaacaaccccatttctccccacctattggactgcgccaagtcaaaggcctccacagtgctcgggttccgctgtagctcctggaagcgcttggtgtagaagtctaggtcccaagagtctaaagccagacctaggagacaaatccaggaagaggtgactatggaactcaggcagccacattccagatctcagcacccctactggcctatcctggaccctacatctccctccccagctactcaccaagctcctggttggccttctccagcgcaagccggccctcacccagtatattgatagggccattgaggggttccggcatgctctcaggggagaaactctggatgggatgggggaagtgctgctctgtcatccggtcgtgcagggtagccagagcaatggcttccacctcagctgacggggggtgggcaaactaggggtgcagacacacagagggcaaggggtgaagagtttaagaatggagagaaatggtccaccttcctaccctcttagtcatgcaaggctagcccactgccacaccatatggcactttttctcagattacaaaaagacgccctttccaggtatgaatccatgccaggatgcacaaattaaaggaagcataggctggatttctgccccatttacccctcaaccaggtactttcaggcagtgaacaacttgtacgaccatacagagcaggcctaaagccaggagcacctgtccctgcttctctctagagcttaggatctaatcttgtatctctggctcatctcctcctcctgattccccatcacctcaccgagagccggtagcgccgggtggtctccacacgatccacaggccccagcccagtggcgcggcacactgacacgatgttggtggatgttggggtggagaagttcagcctgaacaatgggcctgatggttaggactggagaacccccggcaggcctcagctgggagggtggatcctgcccactgctgtctggacaacctcccaccgctatcccctcaccattggctttcagcctcaggctgggcaacaagaaacctgcttttaaagtacactcaaaccaaaccaaaactgtcctctagcatcaaaactatttgatttttttttctttctgtgaggcagagtcttgctctgttgcccaggctagagtgcagtggcgtgatctcggttcactgcaacctctgcctcccgggttcacaccattctcctgcctcagcctgcctagtagctgggactacaggcgcccgccaccacacccgggctaattttttgtatttttagtagagacgaggcttcaccgtgttagccaggatggtctcaatctcctgatctcgtgatctgccccacctcggcctcccaaagtgctgggattacaggcgtgagccaccgcgcctggccaaaactgtttgattttaacttggaatctaatttattttgctttgagaacatgttttggagcaggctaggtctttggagggatctacccaaatggggaaagcacatgtgtggtttcctaggcaggaagtagcaaagagcaaaggaaaagcaaatctcccaaggatcacaagaggaagcaaaggaaagcagaagaaaggggtgggcaggatgagatacttacctgggcccgacctccagcagcaggtcattggagccaggaaggagccaggactcccgagcaacatcatccagcagtaaggggcaaccaaacagccacatcagcttctttgtctcctcagcactggggagggcctcagctgcagggagacagggcaaggacaccttgagacactgcccccagcaccgaggcatgtcccccaagaatctaatacctgggcccaacctgtccagttcacgttgtagcacagttcagtctcgacgccctgcagctctggcagtttcccttgcagtttcctccgagtgtgtccagaggctgccccctcatggccagagggacgaacatagaagtgaaggactggggacatctctgcaggtgtcctttgctggagagaggtgtcctttgctggagagatgtgtcctttgctggagagatgaattaggttcctaaaaaataacattaactaagccgggcgtggtggctcacatctgtaaccccagcactttgggagactgaggcaggtggattgcctgaggtcaggagttggagatcagcccggccaacatagtgaaaccctgtctctactaaaaatataaaattagctgggtgtggtggcgggcgcctgtaatcacagttactagggaggctgaggcaggagaactgcttgaacccgggaggcagaggttgcagtgagccgagatcgcgccattgcactccagcctgggcaacaagagcaaaactccgtctcaataaataaataaaataaaaataacattaactatggcctatctgttgaactgatttcagatttcaaggaaaattgcggcgttatggatagggtaggggaaagtaatatggacatttagagaaacaaggtaacctgaaaaatgtaaccttggagattttaaggaatcttgcaaaatgtggtctttattaatgtggtagggaggtgtacaggcacacacctgacacgtgttcctggagtacatgcactttgctgggccccagtcaaggtcttagaaacaccgctgtgaatcaagacagaaactctgtctgctctcacagggtttatattttattgggggagaaaggccaagtacccagacatttccagtcccgtgtggtgaaggtcaggggactgtggacaccaatcctgcacttcaggtgtcaggaaaaatttcctgagagaaatggtatcagccatggattgaatgtttgtgtatctccccctcccaattcatatattgaaaccctaatcctcaatgttatggtatttggaggtggggcctctgggacgtaattaggtcatgaaagtggaactctcaagaatgagctactaatctcaccaaacctcttataatctgcccttataagaagaggccagattgggcggggcatagtggctaacacctgtaatcttagccctttggaggctgaggtgggaggattgagcacaggcgttcgagaccaacctgggcaacatggcaaaaaccccatctctctcaaaaaagatacaaaaatttgctgggtgtgctggcatgtgcctgtagtcccagcaactagggaggctgaggtgggaagatcacttgagcctggggaggcggaggctgcagtgagcagtgatcaagccgctgcactccagcctgggcaacacagtgagaacttgagatcaggagttccagaccagcctgaccaacatggtgaaacctcatctctactaaaaaaaatacaaaattagccgggcgtggtgatgcgtgcctgtaatcacagctaattgagaggctgaggcaggagaatcactcgaacccgggaggcggaagttgcagtgagctgagatcgagccattgcactccagcctgggcaacaagagtgaaactctgtctcaaaacaaacaaaaacaaacaaacaaaaaaggatctctgatcacaaagcttttgtttaagaatttattgcttgatgatatcatgtcataaattatttatttatttatttattttctttttctttttttttgagatggattcactctgtcaccccaggctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactccagcctgggtgacagagcaagaccccgtctttctttttctttttttgagatggggtctcactctgttgccaggctggagtacagtggcacgatctcggctcactgcaacctctgccttgcgggttcacgcgattctcctgcctcggtctcccgagtagctgagactacaggtgcacaccaccatgaccagctaatttttgtatttttagtagagatggggtttcaccatgttcgccaggatggtctcaatctcttgaactcgtgatccacccacctcagcctcccaaagtgctgggattataggcgtgagcgactgcgccaggcagacctcatctttcaaattaaaaaaaataaaaaaaaaaaagactcccacagtggaaccaagtgagcatgagaatcagtttcttcatctccctgtttcatgacctcaccctgcactcttcaatcaatgattttcacacttcatcctaatcctattccaaactcttttttaaaaaccctagccccaaagtactctgggagatggatttgaggtttcctcctgtctccttgttcagcagccctatgattaaacctctttctctgctgcaacctggtgtcttggtgtattgacctccagtgtgcatcaggcaacagaactattacagttaatacttttagcctaacattcaaaggccctccccatctatcccaaactacctatccaatttctggtcccactgcctctcagcgggaccctggctttactcaccaaactctgctgttcccctagtcttgccactcagtaaacactaccatcatccaatttgttgctcaagacaaaaacacagaagtcatccttaattctctttccctcagactctctaaatccaatccaccaggaaatctatttccaatcatgtctcaaatctctcatctcttcatctctactacctcactctagttcaagtaagccaccaccatcactcacctggaccaatgcattaacctcctgaccactgcataaccacaattcatttgtcacacatcagcataaagtggattatggcttcccattacacatggtataaattccaactcagcatcctggtttaccaagtctggccactctctggcctacctttccaaccctatctcacaccattctctttttcacccacaatgcaccaaccacacattagcttcttttttatttctctaacttgccaagctcagtcctggaaggcatttttttcaccctgacatatgcatggctagctcttgttatttagatttctggtgattcgccttcgtggaaaaggcttcactagccactcaagtagttactatcagatggccggccctattttaatttcctgtaaagcgcttatcactattggatgtttttatttttcgctctatattccccactagaaaaaaaatctctacgtgggcatgggatgttgctgcttcgtttccattgaattaccaaggcttagaacaataccagggcttgaaacgcaaaaaaattctaaaacttgtggaatgacttaatgaactcttgattctcaccactcttcagcccctccccaactttcaggacagtcttcctgaaggcattttgtttattaagccacttgatttccgtctatcattcccagtaaaatataagcttcaagagctcagagacagggtttgcgtgcatgagggctgtattccatgaccagcatggtgcctgctataaagtaggcggccggcagtctttctgttagctgaatccatgaatgggacaatggggctaaatttacatgggggtcggccatgcctggggtctgcggaacgcacgcaagataggacgaatggacgcctccactaaagcaaatacgcgggcaccaagtagacacagctcggcccggtggggatactgaagccgccagaccaagcttgggctagatgacgaaacgctgcacctggaggaggatccaggtccgcacgcggtaactatactcacgtggaagatgcactcgcggccacagagcacctcgaatcgtcgcgcgcgtttgttacgtcatccgcgtgcgccgcgggcagagactggacctgccagcgccggggcgactacgccccgcccacttttccccagccacccggccgaattctaggttcttggtggggagaggtttatccccaggtggtttctcccacaaatctgtcttgaactgacgtttgtgaaaatacattcagttccccgtccccgcggggacagttaagtaatgacatcagttagttaaggccataaagcaagcatgtgaaagttgtgctttggtggcattacgaggaagcccttctctgcttggcaagatcagggagactgaaagatgcttagaagtcatccaccaggcgggctgtgtttgagttcctgagctctcctaccccatccatctgaaggcctgcgggatgccggacaggatgtcacttaggagggagacggaggctgggcgcggtggctcccgcctgtaatccgagcactttgggagcccgaggcgggcagatcgcttgagcccaggagttcgagaccagtctgggcaacatggcgaaaccatgtcgctacagaaaaatacaaaaattagccgggtgtggcggtgcaagcctgcgatcccagctacttggtgggctgaggtgggaggatcgcttgagcccgggaggtcgaggctgcagtgaaccgagatggcgccgctgcactccagcctgggcgatagagcgagacctcgtctcaaaaaaatcagagagggccaggggctgtgtttcacgcctgtaatcccagcactttgggaggctgaggcgggtggatcacctgaggtcaggagtttgagaccagcctggccacatggtgaaaccccgtctctactaaaaatacaaaaaaaaaaaaaaaaaaaaaaaaaaaaaattagccgggcgtggtggtggcaggtgcctgtaatcctagctactcaggaggctgaggccggaaaatcccttgaacctgggaggcgggggttgcagtgagccgagatcgcgccactgcactccagcctgggcgacagaaccaggcttcgtcttaaaaaaaaaaaaatcagagaaaagagacaggggtgtcgggagttgggatggtgcaccgaggcgcctcgcggagtctctaggaagcgagggggtgagcagcgagaaggagctggaggtggcgaggaaacccgctcaccggtgacgtcaccgagcgcccccccacccccatccccaccc

SEQ ID NO: 220 - DNA, 10000 bp, Homo Sapien
ggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctctcttttttttttttccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacgtagtcagatggctcacatttggaaccctggtagtaatgttttattctttgtccgatggcattgggcgggttgacccagcctgcagtcaggatttccttgtaccgttcacccgggagttcagaatcgcactctggctgaaagttcagcaagagcaccattgtcagcctgactgccctgtcttgctggaccagccaaaagcttagttactttctggcacagttggaggaaggagctggttcttaacagacgttcaattaggtcttttggctttctgtgttctttcaagcttcttccttttcctttgtaaataatgttagtattgaaagaatagattttgccaagtgattgtcttgtgtctgctgcccacttggcatgaaggtaactgctggtgaattgggggaaaaaaactaaacatttagaacaagcctgtccaacccacggtctgtgggccacatgtggcccaggacagctttgaatgcagcccaacacaaattcttaaactttcttaaaacattatgagatttttttaatgatattttttaagctcatcagctattgttagtgttagtgtattttatgtgtggcccaagaccattcttcttcttcctcttaaggcccagggaagccaaaacattggacacccctggcttagaaccttcagctctgttccggtggtacaggaccagttaggaggcatcaggttctaaccatctggtcataagggaacagatgcgaggcctggtcacagtaacagcccgtgcagagatcaataggaggaaatcaggaatccactgagggtctggggatctaggtagtgtgggctgcaaagcattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttagaacagtgggtctcaatctgactacatattaggatcatctggggggccttaaaaatgaaagctctcacctgacagtgtgtaggtcagccacccaaaggtgagggctgtgcactcggcgcagaccttgacacttaggtccaaagcgcgagtgctcttcgccaaagcttgtctgcctgggctctttcctacctttgggtggtctgttcacaatgaccctttctctgaccagctgattgaaacctgccttctgattgtacctgggtaattggaacagaaccaggagtcatggttagcttgtagggctgcctgcatggctcatgagcagtataactggttgttaacggtccctgtcatgtgaggttttgggggtctgcttcccagacgagctcactgtgcttggacctactctatgcaatggataatcgaactaattatttagataattaagtggctgggcacagtggctcatgcctgtaatcgcagcatgttgggaggctgaggtgggcagatcacttaagcccaggagttggagaccagcctaggtaacatagaccttgtcttcacaaaaaaaaaaaaaaaaaaaaaaaaaaagaaaaaaagttagggcatggtcacatgcctgtagtcctagctactctgaaggctgaggcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgtcagctccttcccccttcctccccgtacgtgctttcagtgagacggaacagttcatttcttccttgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactaaggtgtggcaccgtgcacaacagggcaagtggtcaccctcagagagtggtcctgaagtcctcctccgggcagctgtgaataacactccgagagccaccccgcaggcagcttccctgactgtccaggggcctcgcgtttagcgtggactcagtacatggtgggcaggggcgagtgctagcggaaactgggtttgctttttgttttcatcttttcctggtttagaatttcctataacatgtggattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatacgttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcgaccttcccaccggtgtccgtgcccttttctgttctgcatgagcccgggaggtgtgctcctctttctggccttgctgaggaagcctcctcagtctgttaattgtctcttcctgggtaatttctttattagagaaatcttttttttttttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttccatgttggtcaggctggtctcaaactcccaacctcaggtgatccgcctgcctcggcctcccaaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcctacaggcgcacatcaccacgcccagttaatttattataataataataataattattttgagacggaatctcgctttgtcaccaggctggagtgcaatggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagagtaagttgaatccttcccccttgctctgattccagtgtgaggcctgtgctgcccaacactttttatcgggatgtgggctacattgttgtgtcttgtctgtgacccacagcctcattctttatgtgaggggtggctatgtgaccccctaggaaaggctgctaaatggaaagatgatttgtagagatactggtagaaaagaacaataaatgggatggttctgaatgaaagtgggcacacaggaggggagtgggccaccacccctggccttcacacacacctctttcaaaatccaagccactcactgcatatgtgtcttctttaagaatcccctactgaggccaggcatggtggctcatgcttataatcccagcactctgggaggctgaagcaggaggattgcctgagcctaggagttcgagaccagcctggacgacaacatggcaaaaccctgtctctacaaaaaaaaaaaaaaaaaaaaaaaaaattagctgagtttggtggtatacacctgtggccccagctactccagaggctgccgagggaggattccttgagcccgggaggacgaggctgcagcgagccgtttgtgtcagtgtacctccagcctgggcgacagagcaagaccctgtatccaaaaaaaaataataataataatcccctaccaatatgtgctgttggtgtttgtttttgttttggtatagatggggtcttgccttgttgcccaggctggtctcaaactcccagcgttaagtgatccttctgcctcggcctacccaaagtgctgggattataggcatgtgccactgagcctggcctgctatagcttttttttttttttttttttttaaccgtaaccagaaaggggttgcgaatgacatctagctgtcaggtctttaaagtattgtatttcttagagtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgagcagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtgggggatagtggaggagtagtaaattcagggtccctgcatcccacgagctggcggctgcatctcacttcataccttcactgtttttgtttttcccatctgtgtttgatcttgcctgtagatccttggtctactgttatagatgagaaaaatcagtctctgctttgcaatattttgtatatttttctgttatgccagagtgaggacttagaaaattaaattagaaatatttatatttgccacacctttcttcccttttgggaaagaatcctgttgagatagtgacgattcagtgttagcacttagcaggcgtgtttgtagtcaaggtaataaccatggcttatcgccaccaattcccgctgtattacttgtacatcatatcttctgaagccagaagaaaagtttaggacaaggagaatgaattatttcaattccaggatctgattagtcctaggctgaaaatggttttaaaccaacaaaagccccagaactccactcccctttagctgttcatggaagggtaagaggtctgagacaggcactgaagagggccagttgctgggacagtgtccattcctacgctgccagacgtgagggatggctgagtccttttggactctattgctgtgggtgttctgggctgtgggaatcagtaggtctgatcccaaatggcagtttctgtgccgtcccacacggtctgctgggctccataaaccgtcatgactcagcagtgtgggccactgaccagccacatgagcagcatctggagtttcttggaaatgcaagttctcaggctacaccccacagctattgcataatctgcacggatctgaactgcttttttttttttgagacggagttttgttcttattgcccaggctggagtgcaatggtgagatcttggctcaccgcaacctctgcctcctgggttcaagggattctcctgcctcagcctcctgagtagctgggattacaggcatgcgcacaggaaaaagttgtatctaagtagagaaagtgttttccgctcatatcctgggtccacatcgaagaattcagtccttgtggatgaactgtaaacagcacccttcctctaagatgccgaagatcatagtttgtggtttttttctttcaggcggtggaagcagggcagagccgaagcagcccgctcctcaagaggccggtgcggacccaggcggtgctggaccagtcagatgtgtacacccatgtcctgtcagccttcgtggaaaagaaggtgggccgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatgtgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacaggtaccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtaaggtcaagttggggtctttacctgcatgacgaaaccacttcttgtaatgacagacttttactgtgttggttagaatagccagtccttggggagcctctagtctgttgtagctgaatgatttggaagtgttctttcactttttacttttgtcctcagcattacctacatgaacttgttatcaaaacccttgtccagcacaacctcttttatatgctgcatcagttcctgcagtaccacgtcctcagcgactccaaacctttggtatgcattgccagatttttacttccattgtggttaaaaatggaaaattttaaccgttatctttccaactgaagtgggtctaaaaatgtctttcaggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggtgagaatgcaatgaaaagacttggggtaaccatagcctcaaagagtagcagagggcactggcagctggtgggcgaggaccctgggttagcatttttgtaaacaacacaatttgataacagcccacctagcccttggcccattatttgtagtagagtgaattcagtatactgacagaatctgaattatgctctggaactcaccgaggaggtgtgttttgagtcaagacacatttaggacccagatcaggcacagcccatctcttatagcagatcttggaatatctcttaaagccaggaataagacggcaaatggtggctaagggttttaaagggtctggggcttattaaggtttcagttttatgaagtatacattggttgatcattctcattttttttttgagacagagtctcgctccgttgcccaggctggagtgcagtggtgtgatctcggttcactgcaacctccgctgggttcaagcgattcttctgcctcagcctcctgagtagttgggactacaggtgcgtgccaccacacccggctgatttttgtatttttagtagagatggggttttactatattgtccaggctggtctcaaactcctgacctcatgatccgcctgcctcagcctcccaaagtgctgggattacaggtttgagccaccgcacctggccctggttgatcattctcatctccaaatagttatacaacctaagacatcatctttaggatagggaaggatcagggctgtctaatgaaacttctaggtctatttctagctcaatgtaagacggcatttagttaccataaggacaggttagatagaatctcttccatttagcttttgtatttgtctctcaaagcagatagggtaaccccaaaa

SEQ ID NO: 221 - DNA, 10000 bp, Homo Sapien
caggcggagcgaagcctcggggcccgggcccaggttttgtgcctacggaggctggacttccccgccaccccgaggagtcaccgagagccttctctccctcgcaggggccctgggaggcccgcgctttctctgaaagtggaaggagtgggcggggggcgcggccgaggcggggcgcgggcgtgcagcggcgcaggctccgccccggggccgtctccagccgggggcgccgagccgctccagtccccggcgcgccgcgggctggtgggctcagcggcggcgccggcactgggaaatgaccctgcccgggggcccaacgggcatggcgcggccggggggcgcgaggccctgcagcccggggctggagcgggccccgcgccggagtgtcggggagctgcgcctgctcttcgaggcgcgctgtgcggcggtcgctgcggccgccgccgcgggggagccccgggcccgcggggccaagcggcgtgggggacaggtccccaacgggcttccgcgggctcccccggccccggtgatccctcagctgaccgtgacagccgaggagcccgacgtgcccccgaccagccctgggccgccggagcgggagagggactgcctcccggcagcgggctcttcgcacctgcagcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcaggtacgggccgcgggggcggggccagcgccgggcgcgggggctgcacgggggacctggctgggtgctcccggaggacccgctcctgtccatgctccctccagcggaaggtcctgttctcgcggtttaggaggaatctgggggtcagagggaggcgcctggccgacctctcgcctgggcaactttcacctcggctccgccggcgggtcgtggcgctggccctggggcgtctaagaagcggggcgaggagcaggcgacccgccgcggggactgggcgaagcgggggtagcggaccttgttggctgtgggttaggacaggagggatcggaggggctgagccttgccgggtgaaccctcggaaggagagaggcgaaggagagtttcccttaccccccgccccctctccggtgccgcggccgcacccccgccgttgccacggtttccctctcctgagtgggagtggagcggcgctccaggctctgctcgggagccgctgccgtctgctcccagcgcccgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcggtaaactgaggctgcaagggggcaggatcactctgctagtctctgcctctgatagcctgggtgttctgggaccaggtctgaccctcggaaaacacagccctgggcactgttaagtcattcctgacgcccgccacttagggatgtgcggctcccgggacaccctccttgttcccctcgttttaaccaaggccaaataccttgaataactgtccgtggtcagcgcgaaggactttctttagatccacgtttcgcaagtgtccctgaggccgaggaagaggcgaggggcgcccccggcctcgggcgtctggggcctgcccataagtccgggtcggcgcggcggggcggggagagctgtggccgcgcgcctgctccgccgcacaatcggctgggacaaggcagggaagctgtggcgacctgcaggggttcacaagcccggaggccgatggggtttgtcagtgacaccagaggggaaaagcctcacagagcaggaacaccccccgccgccaggtgctgggtgcgccggctcggtcactagcctgccgcttccccttcttccccggtggtcagagcagccccggacccaggatcgtttctggggtaacccttgcctaggtcggggggcggatgccggggcttcccaggatgtggagtgtggggcagtgagaggccccccgccccgcctcttcggaaaagcctgagcagcagctcccggggcgcggaagctctgacacctgagagccggtgcaggcgaaagggcgcgaagcgcgggcgcgtcccgcttccctcttccgcccgcagggactcggcgaagtgcctgggagagggagtgcgctaggaggaggtcctgcggcccaagcctgggtgtagagaccgccccggctaaggtcaagcctcggggacctgggcgaccccgccgccctccgagccgtcgggagccggtgcaaatcgccgctgagggcccttccagctccaaggctgcggcttccaggccttccccacccccaggcccgccggggcctccccgaagtcaaacagccacagcggcggcagataagccaggggctgttgacagaggctgcctgagtccgtgtggaagggcccagggcggactttgcctcgccgcaggtcccagagccgcacagcgcgccggcccaggccaatttagggcttccccaggcaggaagcaaggctggtccggctgaccgtgaaggatgcacgtgggccggactctaggactcccggcttaccagccccttacgcgcggcccaggcaggccggagcccaggaagtttctgcctgcctgcctgcctacctctctgcctggggcatacgtagtccccttcacctcctaggagccctctccagcctgcccagagcagggaaattgaaactgggcagcctcactccggcagaggaaaaagtcacaggcaggcttttcctaaccagccaggggagaagttggaggcccacccgcaaggtcagctgcatgactctatggccttgcctgcctcctcaaacaattgtggggtattgctggaggaaaagagagggtgtttggctcctgttcatctggttttcttctttctgtgctccaggataggtaaggagacctggatgccatcccctcctggactcagaattcccacacatcgctttccactaattatagagcagaatttaggttaacagacttcctttttaaacagctaatgcccatgggaaggtgaagtcgtgggtcacttataccttagtgcaaatcgttttataaatttaaactgattgctcttcccaccaccacgaccacagggagtgctagtttgatagggcaattggaacatggggagggtattgggctggtagagagcttcaaccagagcctggatgactggaggcagggagcaagggtgagtgccaaagacagagcactcacccacctgctggtctgctccagcagaagatacactgtgtatctggcatgagcaggtgtcttcaaggcttccgaatggagcttagacaaaggagggtctgaggctagtatccagccaagccctgcccagagagaggtactccctgttcagccctaggagtgaggaattatcagagggccctcctgtgacttcattaaagtctctcacacagtcagcaatcctagcctttgcctcaagatacccaggtagcctctggctgtgtgttagtctcccagagagggcaccttcatggagggaggcccgagccagaggatgttcaagcttctcccgggttcaagcgattctcctgcctcagcctcccgagtagctgggattacaggcacctaccaccacaccggctaagttttgtatttttaatagagatggggtttcaccatgttggccaggctgctctcgaactcctgacctcaagtgatgcatctgccttggcctcccaaagtgctgagattacaggtgtcagccaccgcgcctgggcttacattcatttttaaaagcgtgatgttctctgggggaggtatctccctaaggtggaaggtggcagtgatttgagttccatgacacttgcacaactcctgccatgcttggccatacccattactggcaggggggctaaatcctgtcatagcaacctcaggtggtaggacggaggactcagatgagataataggtatgaaaatcttttgtaggctgggagcagtggctcacacttgtaatcccagcactttgggagtccaaggcgggaggatcacttgaaccccggagttcgaggccagcctgggcaacatagcaaaatcctgtctctactaaaaatacaaaaaaaatgtcacggtggctcacacttgcaatcccagcactttaggaggccatggcaggtagatcacttgaggccaggagtttgagaccagcctggccaacatgatgaaaccccgtctctactaaaaatataaaaattagccaggcgttggtggtgcacgcctataatcccagctactcaggagactgaggcaggagaatcgctcaaacctggaagacagaggtagcagtgagccgagatcgcaccactcaaataaatatgtacatacatacatacaaaaatacaaaaaatcaaccaggcatggtgactcacatctgtagtcccagctactctggaggctgaggtgggaggatcacctgaaccctggaagtccaggatgcagttagctgtgatcgcaccactggactccagcctggacaatgggagtgagaccttgtctcaaaaaaaaaaaaaaaaaaaaagtattttgtaacctgctagctaggactggccttagttgctgctgctcttgattcttatgagatgcagaaaaccaaggtcaagagagtaggtgatgacaccattttacccctgcttgggagcaggtccatcaatcaaatggtagtagcccaggtttttagacacacatcaaatcctcttctgccaggcccacctgccagccctcctcactgtttctgcacagttctaaaaggatggttcagttccctcaccctgcctaacccaaggcaagtttcctcttcactaagtccattctggtcccactatcccctaaattcttctagcaggtccctacagccattaaactcattcttttggataaaggcaaaggtggccatccagtagagaagggcccccaggcaggtctcagtgttccccagaagtcaaaactcagactgccttattgctgcacatcacttcaccacgcacaaagcactttctcaggccacatcccatttaacccccaaagggaggcaggatggtagcatcctgctggggatactttggaacctgctggggcagttggaacttggggagggaggatgggctgatagcttcagccagagattgggaggctggaggcagggcatgaggggatgtaactccccttgatttccttctgtaaaatgggaatgataccacttcacgcacttgctatgcatgtgcattcattatggctctcaaactgagtgtgggagaagggggtacaggatggtgctgctgaatatacatggcacatacatcatcttcctggaattttacttgagggtttggaggtggtgagttttataataaaacttggatttattatgcagcagaatgcaaacctggtgtgtatttaaagattttaaaaggagttttgaaagtgatgtcatgcttctagtgggctgcttctggctacacccccagatccctggggattgggcacgtgatcacaccctagtgtgccatgtaagggcttcagtaggaaagtgggagcaatgctgcctgatggaagatgagaaagtgcctgacatgcaataggcaggtagcatttgatggttcgtgttacggcagcagctatgtcctcccaggggaaacaggcccacacagatggcagtacttggttgggttcactcagctggaaggtgacacagccatgactggaaccaactactgacttcccacccagtgctctaccataacttccatctcctccccatgggaaagggctttatggtcagcagccctcttctacttaggccacctcctcagttctctctctccctcttagaactccctcttgtcagggaggtgtattcctctgggggtacaacatgtgtaactgtgctaaaaggcaagtgcctctgtggggaggcggcagacacagttgacatgagccaacctgtgtacttcagagaggacacagggctgccgagttgcgggtggtaagaggagaggtccagaggatgggatgctctcaagattagctggaggctagaagagataaggggcacaccaaaaaaacaaaaacaaaaaacaaaaaacaaaaaacaaccctcgtctccttcccaggtttgtctaagttgacaggccctcaggtttgcaccttattttctttctttttcttttttttgagacggagtctcactctgctgccaggctagagtgcagtggctcgatcacagctcactgcaacctccacctcccagattcaagcgattctcctgcctcagcctcccaagtagctgggaccacaggcgcatgccaccatgtccggctaatttttgtatttttagtagagacggggtttcaccatgttggctaggatggtcttgatctcttgaccttgtgatccgcccacctcagtctcccaaagtgctgggattacaggcatgagccacctcgcccagcccggcatcttattttcatggcttaagatttctaggtccagataaaaaccaagggtgccctgggccttgccagctaatgagtgcatagaatccagggatagcaagagaggcttggagagccttttctttctccagccctgttctttctccaggccctgccaggctggccttcctgccctgggcctgtgtacaggtttgtttctgtgtatgtctgtctccctaaatgagaggaaccaaggtcctgagtgaaggaatcagtgattgagatttgttcagcttctgcctcataccatggaatgggatgggggagctgggcgcctatcatgcttaagccttatgtactactcacagcaacccagtaaggatagttatttcctcattttatagatctttttcttacagatgcacagaggcttgtttcttgggccctggaatcttttgaggcattggtagtaataaaaatttggggggccgggcctggtggctcacacctgtaatcccagcagtttgggaggctgaggtgggtggaacacctgagatcaggagttggagaccagcctgaccaatatggtgaaaccctgtctctactaaaaatacaaaaaattagccgggcatagtggtgtgcacctgtagtctcagctactcgggaggctgaaacaagagaaccgcctgaacccgggaggtagaggttgcagtgaggccagatcgcgccactgcactccagcctgggtgacagagcaagactccatctgaaaaaaaaaaaaaaaaaaaaaaaaatggccctactctagaccaacttagaacatccctgcggtaggcctgataatctgcaatttttaacaagggtgaccatcaggtaattccgatgttcacaacagttcaaaaacctcgacagagcattttcgtaacctgcccacgcgttcttcagtggcagagctggagcgcaaaccgggggcttcagatgctaagtccaggctcttgacagctcactggagacgctggaatcaccttcactgcgcctgtatcagcacccgccacacaggcgcacaaataaaccttcccagagtgaatgaatgaattaatgactcatccagccccagctgcttccggtgggtcgggggcgtggcgagaccctgtttcagtggagggagggcttatgcattgccgagacgccgattatcagaccttgaccctgtcgctttcagaaaaaccactggcagaagatccggaccatggtcaatctgccggtcataagccctttcaagaagcgctacgcctgggtgcagctggcagggcacactggtgagcagtggggcgggtgggcgggtgcccgcgacgggaaggggctgggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggggtctccgtgtgcgccccctcatgccctggccgctgcctgcgcccccacaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaaggtgaggcaggcgcgcttcgctggcaccgccgcagccccactgcgcgctgtctttcccgatcccccgctcccgccccgcctgcccctccgccctctcccaccgcctcgccgtcccctgcaactgggaggtaccgctgctctacgctgtcctcttccccactggcgggcccggggcccctgacactcctgtcccacatccagaaagcggacggctcctgcagcaccgacttcaagactacgcgaagccgagagcaggtgcttcgcgtctttgaagagtttgtgcaaggagatgaggaagtgctggtgagagcgggatcccaaaccctgaggtgttggggagcctgaagccgaggactgcccctgtcatctggcccagtgccctcggctgtgtccccaccatggccctcaccgcgctggctcgcaactgctctacgctccttcccttctgggccacgctgggcggggccctgggtcctcctcctggcggcatttgccaagcacagcgtgggtcccggctcctcatcgttagcaggggctcatttggcgtttagttaatttgccctcctctcccaccccaccctctgcagaggcggtatctgaaccgcctgcagcagatccgggacaccctggaggtatccgagttcttcaggaggcacgaggtaagcggcggctgcccgggtgcccgggccgcgagggctagggcgggaacccggcaagggcgtctctgggcagggccgcggcctgacggtgcggggctcgcaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacggctatttgctggggctggacaatctcattggcatcctggccagcctggctgagagatgaggctggactcctgtccccgcgggccgctcacctgacatgtggacctgcagctttgtccccactgtgcatgccggcttgagactggagccccgcggtgcagggcagttcaccgggtcctgcaggaccaggtgccagccactaagggggggcaccgccgatgccaggggttttgcccacccgggccccagcgttcccagagccaaatgacactaacttatagaaggggagggggcaaagggcttcttcctcaggccagctcttctgaggaggctctgccctctccagaggtgccagaccgcggattttatttagcaagcccagaccttccggtctaacgtctcacaccacgacggactccccttcctaataaaactcaaagacaagatgcagcttcctgtgcctcaggcctcagcccctccctcctccggccccctcttcctcagttccggtccctggcatccacagatcgc

SEQ ID NO: 222 - DNA, 10000 bp, Homo Sapien
tatttttatttttaaatttatttatttattttttgagatggagtctcgctctgtcacccaggctggagtacagtggtgcaatctccgctcactgcaagctccgcctcccggattcacgccgttctcctgcctcagcctcccgagtagctgggactacaggcgcacgccaccatgcccggctaatttttgtatttttagtagagacgggttttcaccatgttagccaggatggtctcgatctcctaacctcgtgatacacccaccttggcctcccaaagtgttgggattacaggcgtgagccaccatgccagaccttaaatatttttaaattattattattattatttgagtctcactctgtcacccaggctggagtgcagtggcacgatcttggctcactgaaacttcttcctcctgggttcaagcagttctcctgcctcagccttgtggaggaatagttaaatattaaatgtgaactcatttggttgtggacagaaacaatggtcaccaagtctcggaacaggttgtgtgagccccttaaggcgttcatccagcactgtttcaaagaaatccctatttcaatctattcctatacgttagttattgaaaaacaatagataattgcaaaaacaagttgacctttttgtgttccttgagccccgtcacgaagggccctcgtaactggacctcatgccaaacaactcgttacaaaaagagctagggtctcagaccacgcagaagcttcatgagacccctccttgtctgcatggacaagtggtcgactctggatcccaagatgttgcttcccagtttggtggtgaatcctccatagtctggtgagtgtaagtatctttttcccttctcttcccattgcaatttgcttattgtaacaatatccttattatattgattttcttattatatcatttgcttattatgtcatttccttattatatctgcattgccatttacatggggtaaagcttgtttaccctttaaagtattgtgtgtgtgccatttcttctcccctcatgcatttcctgcacagaacatcagccttcccagtagctgggactacagatgcccgccaccacagctggctaatttttgtatttttagtagagacggggtttcaccatgttggccaggctggtctcaaactcctgacctcaagtgatcctcctgcctcagcctcccaaactgctgggattacagatgtgagccactgtgcccagcctgagttttatttttaaacatgcatctttgaacactatattttgtctgacattactaaacttcacaaaaattaaataataaagtatgtaattatgtccgatgtctctagtccttatgagaatcataaaatattgattgtagttgtcatttgtttacattaactatttgattgaaataatatacctgcctggtgcagtggcatatgcctgtcatcccaacactttggaaggccaaggataggaggatcacttgaggcccagggctcaagaccagcctgggcaacacagtgagactccatctcttcaaaaaatttaaaaattagccagtcatgatggtgtgtatttgtggtcccagccactcagaggctgaggtgggaggatcacttgagcccgggagtttgaggttgcagtggtctatgattgtgccaatgcactccaaccttggcaacagagcaagaccttgtctctgaaaaaaaagaaaggaagaaaaataaataatacacataattatacacaattttatcgttctggatggacatttcaatagcttctagttgttgaaatgtgttggcatttgctttgtgatcagatatggctgcaatgtttactaatctgtgtattatgtgtttgaaaagaatgtgtgttctacaactgttggttgcagtcttcaatctatatatgtcaattagattcaaatctatattagttttatttatttattatttctatttagaaggtacgagtactttgttttcaacaaaatttttacaatgaatatcgttcatttgaaaacatagcctttgtctcacaaatcataaccctttgttatttttactatttgttatttttactatttgtgactgtgttgctgtgtgctacatctgtctgtctgctgtgagagggatagtggtataaataagccaggcaacttcctggggttttaatatccaaggaacagaaggctggtctggggtacaagaaaaacgctctgacagtttctcgggatcgcgtgtcctgcatataataggtatggaaatgtcaaatgcacatctttactctggaaagcagaagatatgtagaaaccgggcagctgccttatggtgaggaaagctgttgctattatacctgcctgtcttactgactttataataatagattgtcccagtgttaagtaattggttttgaccactattttgtgttgttaagacgtactttccttccagggggcatagctgtttctggaaacaacacactgtaagatgcttttcttaaaccattaatagtcgaggaaatgttgccacttgaatctccatctcagtaaaagtgggaattgacgtggtgatggttgtactggattagaaccatgccaggcacccagggtttgatcttcctgggttgtataaatcgagcggttgtttgtactgcgatgctttgggagacttttttatttatttatttatttagttagttagttagttagttattgagaagctttgggaagctttgagattaaactgctgaaaaggaatcttgtttgatttcatggctgatgttaaaatggaagagttgctgtgcttctcattgtagcccatggaagctacttaccaaacagccacataaagataaacacatttagctaaaaagaaagaagaaagaaagaaagaaagaaagaaagaaagaaagaaagaaagaaagaaagaaagaaagagaaggaaggaagaagagagagagagagagagagagaaagaaagaaggaaagaaagaaagaaaagaaagaaagaaagaaagaggaggtagcaaagtttttcacagaatgtctcatccagcaaaatattttgagtacatacgacctgttatgcacatctactgaggcattcatatatgtgtaactttatacattactgtgattattattactaccataatatcaaagtatttttcaggtaaaataaatggacatttaaatactcagcacatggaacgctgaattatttcaagcatttcttttttgaagacactttcctaggaattcaaacaatgctaaaccctaatataagtaacttttgatacaaatacaccaatatctgctgaagactatctggggtatttaaataaggcctgaaaggctgtggtagaagaaatattaaaagtgagatggaggctgggtgcgggggctcacacatgtaatttcagcactttaggaggccgaggcaggcggatcacgaggtcaggagttcaagaccagcctagccaacatggtgaaaccccatctctactaaaaatacaaaaattagctgggcatggtggttcacgcctgtaatcccatctacttgggaggctgaggcaggagaatctcttgaacccaggaggcggaggttgcagtgagccaagattgtgcccctgcactccagactgggggacagagcgagattccatctcaaaaaaaaaaaaaagtgagatggatagattggtaggattgagtgggaccttcacaaacagggattcccagaaacatcttgtagatggactccagctgtagaaagtgtttcatccatccctgtcacgatgaaaaaataagaacatggattaatatcgatgtttcagaaacttaaatgttccacttacagttctttatttggtgttctttttttttcctgacattatgtcaatactatttttttggtgttaaaatagaaacatgatgatactagctgtttttctaatacatgtttacttgacaacactaaatatgaacagccctctgtgattttataaaatgcaggagcattttctttttatattaaatccagaactttaggacccgagatgtttagaagagagcccaagggcactaggattctagaacctggagaggaggcaggacgtgaaagcaccgatggccaagtcctatcctcccgccagagctccacctggggattggttggtagatgactgaggtcaactgctttcatttgatttattttcaaacaggaaagggaaagatgagaagatatattgtgtatcttctcaatgaactctaaaaaaattgagtacgatattcatggaatcaccttatttcaggaccagcccagcagaaatctaggcagtgatctgatgtttattcccaatcgtttggtttttatatgtagggattgggatggtcctttgcatttataggcaatacgttaattccttttcaaatatcttcatttaacacagctaactgaaaggctcaacactccagtgaagaagaaaccacaaatgatgaacaaatgttttgtcactctttcagattcagaaattttgcttgaaaaaagtctgaagaaactaatttaggaaagaaacctctgccaataactctaaagagtttgaattggttgcctttattcctaacactatgatgttttgggataggaactagtagatggtattttttctttcccattggcagtatatcatttacaacagatgttcccgactcaggataaaatgtaactggcagccagagtcacccaccagcccctgaggaaagggctcaaccttgagaacatctggctggcttcaagaaggtcacacaaatacaagatgatgctgaggataagacaagtggttttgagagaggaaaacctttaaaaatatttggaagagtcctgaagaccaataaaataaagacactgcaatacttcatggacaccagagagcaatttaacactgaaatgaaagcaacatgttgcacctgaacactgaaaaaagcccatgtgttaagaggaagaagaaatatgcaattcactgcaataaatattgaacctttaaaaaacagaaggaacatgaaaactaaaggacactgggccacagcaaataaggtggcggcagccatcccataatgattacatgatctccatgattgtaaaatgtatatgccacctgaatttattcttagaccttctctcaaagatgtctgcattcaacacaggcaataactgcaggtaatagtgaagaatccttcaggcatgatagaggaacagactaagtgtgggaaaaggaagaactaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgggaacccgggaggcggagcttgcagtgagccgagatcccgccactgcactccagcctgggcgacagagcgagactccgtctcaaaaaaaaaaaaaaaaaaaaaggaagaactagtcaaaattgctaataaggccgggtgcggtggctcatgtctgtaatcccagcactttgggaggctgaggcaggccgatcacctaaggtcaggattttgagaccagcctgaccaataggatgaaaccccatctctacccaaaatacaaaaattagctgggcgtggtggcatatgcctatagtcccagcgactcgggagggtgaggcaggagaattgcttgaacccaggaggtggaggttgcagtgagccgagatcatgcccattgcactccagcctgggcaacagagcgagactccatctcaacaacaacaaacaacaacaataacagcaaaaactgctaataaaaattttaacgagaatatttcaggaagtgaatgagttgtgttcatcttcaaatgtgtgaaaaattattcagtgaaaagatgggcagcttagtcttatgttgctctagacactatcatcaggagcattgggtacaaataggaaaacaatcagagcagtacatacagggaatgtgtattctgcagtcaacataattgttggagttgttagagaggttactagtgtgtggagagaagtatgacgaaagtccagtaatgaagagttttgttttgttttagcagagatgactaagtgataagaaattcatttgatgcctgtgtaatggggcattttgctataatgtaagctgttataatcagacttttcttgttcatagattggcaaagcatcatattggatatcttagattactgacatcttaaaaaattaatcagcctaatatttttaaatgcatttctttttgagtttacttttagttgaattttgagatttgtttcaatcattattggaattttgtagatgtcttctgatttccctagggaatgcctttgtgtccaagaacaagaaacataaccaataaagaacaatacatccgtagttttcctatattagtagaaactatttaaaggagatgaaaatggaaagaagatcatgaaaaaaataaaactccaaaaatggagctacaaaaccgacttgtaggtccaagatcaatgaaagtagaatacggaagtctggaaggaactatacattgtccctgacttacgtaacagagaagaaagttgggaagaaaagtgtgggcaacctccccacaagagaccagattaaaagccaggaagaaggctgggcacggtggttcacgcctgtaaacccagcactttgggagcccgaggtggacggattgcttgaggtcaggcgtttgagaccagctggccaacatgtgaaaacctgattctactaaaattactatatatatatatatagtaatatatatactaattatatatagtatacatactctatatataattgctatatataatatatactatatataattactatacatacagtatactatatatatacacacatactatatactatgtatagagacagtatactatatatatacacacacatacacacacacatacatatatatacacacacatattatatatatatatataaactgtgcgtggtggctcacgcctgtagtcctagctactcaggaggccgaggcaggagaattgcttgaactcaggagccagaggttgcagtgagccaagactgtgccactgcactccagcctgggtgacagagtgagactcagtctcaaaaaaaaaaaagtgaaaccccatctccactaaaaatacaaaaaaaaaaaatagctgggcttagcagcagacacctgtaatcccagctacttgggaggctgaggcaggagaatcgcttgaacctgggaggcggaggttgcagtaagcagagattgcaccactgcactccagcccgggggacagagtgagacttcatctcaaaaaagaaaaacaacaacagcaacaacagaaaagaagtaactcaaaatgtttcaaagaagtaactcaaaatgtttttctttctttcttcctttttcttctctctttctttctttttctcctctctttttcttctctctctctttctttctttctttttctttctttctttccttcgttctttctttctgtctctctctcttttctattttttttttttgatggagtctcgctctgttgcccaggctgaagcgcagtggcgtgaccttggcttactgcaaccactgcctcccgggttcaagtgattctcctgcctcagccttccgagtagctgggactacaggcgtgtgccactacgcccgactaattttcgtatttttagtagagatggggtttcaccatattggtcagtctggtcttgaattcctgacctcatgatccacccaccttggcctcccaaagtgctgggattacaagcatgagcccctgcgcctggcctagcaccttctagttctaattaggctgcatccatgagggtggaagaactgtctctggaaacaagcagtaattaggatgagaaaagttgtgttttatggggttatgcagtggtgagctttgtttgatcgtttaatgggggaaaacatggaaactcatgccccctaaaacgtttatataatagtatccccgcactgaatttttctaagtcagacttggcccatacaatttagagttgatatcctgtgcttttatgttgctttcccagtttctctatttccatcagcagctgatatctttgtagttgctctagagcagagggctcagtcttttcaatcttgtggtccctttacactcttaagaattattgagaaccaccaggaatttttgttaatgtggatgggttatatctagctatatttatatattttaagttaaggctaaggaatttaaaaatattcatttattgattcattttaagatagtgatgcacctatttcatgctaacaccaataacttatttttatggaaaaaaaacaacaaaatgaaaacagcgctttagttcacatttttgcaaatctctgtaatacctggttgaaacggagacagtgggagtctcctcactgcttctgcatttgcagaaccacaccccacactcttgggagcatgagaatgagaagggcaagtaacacagagggtcattagataaatggttttgaccttatggactctctgaaaggaataggaagtcctcaggggtcccctgcatcgaggcctccctgatcaagggagccaagctccaagggttgctggggagctggaggaggtgagatggggcagagaggccgttgtcaccaaaagcgtgtttaggctccattcacttcaccccaggtggcctactgagcccacatggccaccagcgcaactgaagcagaccccgatagaatcctgtgtagaattattttaggattcacccatcttggcatgcacaagccatttcaattgaagaatgttttctaataacaaaacattgtaaacctaagtatgtggcaatagtaatgattaagtaaattatggtttcccgaagcccagtgctctgcagccatcagagagtaaaagcgagaatgtgttcagtggagatagcctcaggatatttaaaagcagagagcacaaagtatagaatcgtgttgtgtatgttatgacctttttttctgtgcttttgaaaaagagaatacacgtatagcaggaaaagacacaccaaactactttatataattggttgtttttgtgtttggtaagatgtatgcactgaagaggaaggtttcgattttttttttttttttttttttttttttgagacagggctttgctctgtcgcccaggctggagtgcagtggcgcgatctcagctcactgcagcctcgaccgccccggctcaagcgatcctcccacctcagctgtcccagtagctagaactacaggggcgccaccacgcctggcgaattttttgtagagatgggttctctccaggtggcccaggctggttctgaactcccgggctcaagggatcttcctgcttcagcttcccaaagtgcggggattaccggcgtgagccaccgcgtcccgcctgtttttaatttttagcagttttaaatcttctggcaatgagtaatgttatagtgtcccagatgtttggtcctttaagaaaaggatagcaggacgggttatctcggtgggagcgtgttccacctctgccctccgccagccgccctcgccggggatgcacccaggtattttcctccggatgcgtgagtggctcgcccgcggacacgccagccccgccccgcgagcccggtttccccgccccctccccgcccacgccctgcgctcccttcctattggtcccatgccgcgctttcccgttcaatcgcagcgcttagcgccagaatttgaatcttcgttttcgtttgaattgggcgggcgcgccgggctggaagaaggaagtggagggctgacgctgcgggcgggcggg

SEQ ID NO: 223 - DNA, 10000 bp, Homo Sapien
agaagtatggtgacttgggcagcatagtttgattttaaagaaggccgggcacgatggctcacgcctgtaatcccagtactttgggagactgaggcgggtgggtcacttgagacctggagtttgagaccagcctggccaacatggcgaaaccctatctctactaaaaatacaaaaaaatagcctgttgtggtggcaggcgcctgtaaacccagctgcttgggaggctgagacctgagaattgcttgaacccaggaggtggaggttgtcgtgaacagagatcatgctgctgcactccagcctgggcgacagagcaagactctgtctcaaaaaataaaataggctgggcgtgatggttcacgcctataatcccagtactttgggaggccaaggctggaggattacctgaggccaggagcttgagatcagcctggccaatatggcgaaacccatctctactaaaaacacaaaaagtagcggccaggcgcagtggctcacacttataatcccagcactttgggaggccgaagcaggcagatcgtgagaccaggagttcgagagcagcctaaccaacatggtgaaaacccatctactaaaaatacaaaaattagccgggtgtggtgccacatgcctgtaatcccagctacacagaaggttgaggcaggagaattgcttgaacctgggaggtagaagctgcagcgagccgagatcgtgccactgcactccagcctaggcgacagagccagactccatttcaaaaaaaaaaaaaaaaaaaagtagcttggcgtggtagtgcatgcctgtaatcccagctactcaggaggctgagacaggagaatcgcttgaacctgggaggcagaggttgcagtgagatgagatcatgccactgcactccagcctgggtgagagaacgagactccatctcaaaaaataaaataaaataagaatagagggcaaagtgagtctggagagagaagtgggggccagatcaggcatgccataggaggcagggaaggtttgacttgatgccacagaagtcactgaaacaggaagctgatgagggccatggggtcagtcctgtgtggaccaatgggtttgaggggaggcagtcaggagtggatttggggaaccccataaggccaggattaccactggtgggaaaggctgccagcagcagctagaattggcataatcatcctggacctctcccagtaagtgcgggaccaggagaaggcctcataaaaaaagacagctagttggaagaccaacctcatcttactcatcttggagtatttttaacccacacactgaatctcaactcaattaatatcaaggccaggcacagtggcttatgcctgtaatcccagcactttaggaggcctaggcagatggatcacttgaggtcaggagttcgagaccagcctggccaacatggtgagacccccatctctactgaaaatacaaaaataagccaggtgtggtggtgcatgcctgtaatcccagttactcaggaggctgagacagaatcacttgtacccaggaggtggaggttgcagtgagacgagatcatgccactgtactccaacctggatgacagagcaagattcagtctcagaaaataaataaataaataaataaataaatgtcagttgaattaaatagatggagattggtgaaattggaaattggcataggagatgaagaaattttctagaacgctcaagagggaaaaaatgctaagtaaggctggacatggtggctcacacttgtaatcccaggactttaggaggctgaggcgggtggattgcttgagctgaggagtttaagacaagcctgggcaatatggcaaaaccctgtctctaccagaaatacaaaaaaaaaaaaaaatagccaagcaaggtggcacaagcctatagtcccagctacttgggaggctgaggtaggagaattgcttgagcccagggggtagaagttgcagtgagctgagattgtatgcctctgcactccagcctgggtgacagagccagaccctgcctaaaaaaaaaaaaaaaaaaaaaaacagaaaaacaaaaaaaaaaaaaacctctgtctttgttggaatttccaaaacgggaaggaagtaggaactattgacagagcaggtgctttgcaaggatatttgtcccttgctctttacagcacatctgcctgtaaggatgtgggtatcattattccacttttattttatgaggaattaagacccagaaaagttaagccacctggccaaaggacactcaaaaagtaggtggcaaagccaggactccagtcccatttttctgcctccaaattctagttatttgccttgccaccattctctctatctcttagtttccaggaaatggccatggggtttgcttcactggaatgcaattccatgagaacagagaccatgtcccagtgatgattaattgctgaataaatgaatgataacgtaaatgagtatgtgactcagccttccagaagtattggaaaagccccatgcactttcctatggcaccagcagatggcggcaaaagagcagcttagcaaaggcagaggcaaacacttggcgtttctttcatttatgtatcctctcttccttgatctttgcaaaacaggtagcttgcatttcccccatcctccaccttcaccactcccctccccccattctgggaggaaccaagaggtagtgctcacagactgcagtcccctctttctgttttgacctctttgccccacctcagagacaaggttatttcaagaaatggaagaagaaataacaccagaagaactttaatggcaatgaaaaccagtgcagaaatgacctttttattgacaaatagagaaaaggtatcatgtccccagctgctgatgaggcagacacagactgtcccccaacattggcctcatcatccatacttttgtgatttgccttgaagggaagtatggggtagaatagaggtgggcagggggaatttcttgttgcgaggaactgaaacggaagtgttggggatgggatggtggcagtggagaggagagggtagccttggtttacatcattttgtttgaaatcagtcttgatttccttgacgccaggaggaaatccatccctaagtggccaagcaccacccagaggcatttatttagtcagggcctaagagtgacaagggacttccctgtgatcctattttaacagaggggaggaaagaggaataactatcttttcccttgaacattctgcagtgtctagactattcctttatgtctgtgaattttcatgtgtggttggtatgtttacctgaagaaaaagtgaaagagacacaagaagggcacaatgatagagagaaaatacatccactgcaaccactacaacctctgccttccaaattagtgggatccctgggcacatttaaacttgacccacacacatgttttgggtagatgcctactttgttctaggctttgctgagcaatgaagagaaagggaattacctgcattgaaagaggtccaagcctcccccttgttcatttttgccccaaggaaaagattcaggtgattctcaggccccaaactacccccttccaaactattcactctgatgttccaaaattcaaacccctctccaagcaatcacaagaataagggtaaaacattaaaaaaaaaaaaaaaaaaaaaagcccccattccaccaggtatgaaaagaactaagcctttctgaagacccaaacatgggtgaaacctgtccatagcacatgtcatcctgacgtatgtggaggtggaaggtgtaggggtgcaggggccagggaacccccaacctggaccccaataatctctccatgaaggggactcccttgtagctcgttttacccttgatcttgaggtgggaggcacctactaaaaagcaatgttgttttatgaaaagtggtttccttttattacctgtgatagcccagtgggggtggccctagcaacaggaaattaacacagaattcattggagggcgataatgattgttcataaccattgggttgataagttaatatcattaattactcaacaaattatacaatgcccgaggccttggggtctggagactatttaagataagcaaggaaatagcgtccttccctgagagacacagagagaaatcttctaaagttaaattctacttagccaagactagaatcgttagggaccacctgaaatgttccccaatcctctcatttcgtattgttcccagagagtgatggggggggtcttaatttatttgggctcacacacttctgagaatcggagataaattgtaggatcccgtcgagaaatgtgcgcctctgcacaataacaaacttgcgtatgatttcaggagattcacgggaagtcctgagccctctcttcctgttagaagtcctagccctgggactaatccccaattagctcaagggtgccggctctggaggagtgggtgccctgggggcggggtgggcgggggggaagccgggtgtcggttggggtggtgggtgcgccatttggcagatacatattcagcgctggtgcttctaacaggctcccactgcggctgtatgcctgggttgggagggttggaggttgagggtgactaaggtaacgaccggagacagctggcgcttctgcgcgagtgaagggcgcccggtcccggcataaaaaaaaaaaaagttttgtcaacgatgcccgcgttcgggactggggtggacaatgcgcaaaagcgttaggaaaaaagttcgcgcccgactgtgggttctgtgcctgcggtgttcttgacgctttggggacatttgggaggcaaagggtgcaccttcctgggcccgccgcgcgggcgcgaagaggacctaggcgagagttggctgtgcgggcctggggaggcgagtctgtcctccgggtgcaattccccaacccgaaaccagagcccgggtcattagcgggaaaccgaagtggcgcggggatcgcatttcaaaagctcaaagagacaggctgactgggagcgctggaattggggcgggggggtgggggggcgatggtgggggtcggggatggtgaggggaagagccggaccgcccggacagtagccgtacagattccaactggttgggtcccacccccacaaaaccctcctctcttttgcgccccccgccccccgattccagaggctgcgcctgagtctcattcactgctttggggagacccgggacccaaaggccgtcagaattcaccccagccgcgggacagaagcgccttacgttttgggggcaggcgctattccctactcaagccagttatttccacccctacccagtgtgcagccagacccaagctctggctctctagggccgtggggcctgcagttgtccaggctgcgggaacctgggccgcactgccgggtaaccaggcagcgcttttccttcgcggggctgcaccctcagcaccccttcgccggcttctctgtagaatccttctttccaccagctgaacccctgggcttctagctggggccaaaacgttggaagtgagagggcggaaaaaactaaaatgtcataggttcctggaagctgggcagggttgaacccagaaagagcgaagatctctctgcctgcggcgtctccacctgcagtccccggactgcgctcggccttggcgcctgggtagacagaacatagcaaatgctagggacgcgggggaggatctgaggccagcagagaaagcctcagacacccaaagccccagtcttggttccagaccccgcgggagagggaaaccccggcgtcagcttggtggtcgccctgcgggccccggcgtacgccagcgctgttggaatttcctctcccccgcggtttccctcgcggttcagatcgggaccagaacgcgatcagcttcagtgccccgccgcaggcatttttaaatagagtattgcgtcccccattcagcctctctcttcctctaccggggaacaaaggccccaaaaccgcggtcttagctgggacgggtgtcccaggacacacaagagggttggccggggagggggatgctgaaataaaagctgtccttttacatagcacgacagatgcacaaagaaatttgaacgttctcgtattaaaaaaaaaaaaaaaaaaaaaaaaaaaaaagcctgcggcacactccaaaatccggaacatcccctcagatttctgtaaatccgggacatatgcgccgcaggtacgtacaccttcagctgaattaggaaagggaattacagtggatcctggagcccacttcggtttgaatcctggctccataatttccccagaggatcttgggtaagtgatttaatggtctatgcctcagtttcctctcttgtaaaacagagataaagatcatatatcgtttatggggttaactgtgaaggctaacgggggtcacttttatggggtgcttcaccgagtgcctggcttgtgcacgtgtcccttgtatgccaagtatttatattattcttgtttcgtgtactttgaactccgacatctgcaacatatacttcttgattatacgcatcttgattataaaacaaccaaatgcatctacatccggaactgtcttgcgcatgaacttctaaacccaaattggaagagacagctacagatggagcacgcacagctacacgcaaacatacacatatccttctaacacctgcagctcctggccccagaatgcagacacccaagagctacccttagataggagtctatactgggctacctacagaagaacccaggtcgccgctggcggcctcgcagctgcaccccgacagccactttcttggctggttgccgtgaggtcacattggaaaccagcgaggcagaaagcgcgctgtcgtgaagcgttgcaagcctctcgtagcggcctgaaggcggctgtctgtctgctggcttaggggaaaggtcagaatctgggttttccttcttggatggaaatttttttaagggcctacacgtcaggaactgtccccacaaagaaagagtgggtcccagaacagcgcagatctagagagaggccctaatcgcgcgagcgcgcacacacacacgccctcttgcacacacccggctccttcaggttgccgggacctcgggaggagggagccgcaaggtcgtgacccctgcctctgcccgagcgcgcccttcggcccctgcaattagcgccgggaggtcagcaggaacccggacgccttcacccgcggctcaaagcacagcaaaaggcgaccccatcccctcccctccgcgggtctcagactccagggcgcagccaggactggagccgaccttcccgacaggcaggggttggaggcctctgaccggcacccgcatttgtcaccttaaatctacaagtcacgaaggtgctgggccctgcaggctgcggtagctgaccctcgtagggactgctgctcccgcgagtcatggcctttgtccttgtagacgcggccaggttaaaaaacaaaaacttccaaagttgtggagtaaaaaagagagcatcctggtactggcaagttgtccccagggcagaatttgaggtgtgtatgttggggaaggaggtatcctttctctatcgacccatcgcgaattcaggttatcccccgccaggcggggtccagaacaagggtctagagatttctacaagcagcaaggaacttgtccagagaattacgagccagggttcccgcactgaattttctaacattctttggaaacccagaggagggcagggctgtttttctcatctgaggcacaaacgggagtgaaagtgatatccaggaaagaggggaaggcagcttcttccgaggctgagaatggggctggggacggaggaggaggggagtggggctgggagtggtggggatgagaaggggcgaaggcgaagcgcccaagttccggaacccgggaggcgctggggtgccgagccagctgcggcgacctggacgcattcgtagacgagacagataggtggcactcgaagcccagaaaaaaggcgaaggcgcctgccctgagtggcctctggggcggccgcagccaccataaagcctgcggcgagattgcgaccggcgccaggtgagtaataggcagcaaaatccagagagactgcgagccgttcatcccctccaccccccgcccatcagcgctacaggagttactcattaacatcacaatatacaaatgagatacacaggagattaaaaaaaaaaaaaaaaaaaaagaggaacgccagtaagagaggctggacacacgtctgagcagggtccccaaatcgggggcggggggagagaagggaggaggtaagcaaatttggactgagaaagaagagaaaagcaaagcatttcttcccttttggaggctgagttcttttttccccaattcgggagagcgcaaccagccaactaccaccttctcagaggcgcggacaccgcgcgttgtcgctggatccagagctgcccccttcaggctgtagccgctgcgcagaaggagcgcgccctggaaatctcccagtcctcgggggagccccagcctcaaaggtccccagggcccgtctcagctcaggccctgccacccccgcagcgcaccccgaccctccccccccccgcgactccgcaccaacatactctggttgtctgtcttccctcccacccccggagacatcgcagaggaggctgtaggggtccccacgtgcctggccagagatggaaggggctttgccccgctctccaaaaggtctcgacctcgatcccttccaagtacaggatgagggaagggagggggcgtcctcctctccggtcattcaagaggcctgaaggtgacagggacttggggccgggctggcgggctccagggggtggcgggtggggggtggggagggaggcagccgccaggcaggctccagctgggtcttcacgtcatggcccccagggcaagaaaagggctaaggactaaccctcgaaccttcccgtgccgcccccgccccccaacagacacacacctcggaggcgaggctgggggtcgggagaccaaaagactgacagtgcctcatcattttttattgaatgtttcaaagataaattgaacttcaaaaggcaactccccgaacagcctggagacgggtttgaaggggagactaggggaggatgtcagcctcctgggtgacttttgccgtggagggggtgaaatgtgcaccctggaattacctttcccctttcggggataatttccctcctccctcgcgtgacacagctaagttttcgcggagctggccgcgctttgcacgcacaactcgggatggatggggcctcgtaggggcgccttgggccagccgggttcaatttgaggcaccagggactgcaggctgtgtggggggttgccgagtggaaaggcgttgcgtcttgtccacttctacaacctggagggttgctgcctagccaagcccgctcggactgctggggcattctgctggccttttccccgagccaaacacactggtgcaagaaggtattttcgacttggattcgccagattgatgtcaaaactgagggcgagcttaaaacgaaaaacattcgtacttgccgagcttacttttggtcggattcgggtgggaaaacctgacttagggagcacatcagtctttttccattaaaacttaaaagtatctgaaattacccttctttctgtattctcatcaggcccctttccgtctccctgctttgctccctaatttaaaggaaaagtaatttcagattgaagtggctcccttcgctcaagtaagggacttttgtttttagctttgtaacttgagtgacatctcattttggttcgctgggggcggtcttaattatttaaaggcgaagggaagggggtaaactcagaacaagaagatactaaaccctcccctgactgtccatcttcaggaaaggttcccaaagaaaaaacatttaacacaagg

SEQ ID NO: 224 - DNA, 10000 bp, Homo Sapien
catttgtttttaactgtagaacaaggtcatgtttgcttcgggcatactacatggagtggactttgggtgacagggtaagccctggctcaggcctgtttttccatgcacgcagcatgcaggctgacagggcagaggccaggttctgaggctttgtagcagatggcctcctgtgtgtgcagggagaacttcttccactcttgcacatacgactcctaaaccttctacctttacggaggcatatactgttgaatgccacctaggcattctttgatcatctgaaacttgcgactaagaggtgggaagagacaactgtcaaccacttagaagtgaccattagttccccgaacagtcaatcaatttaggaatcaagaaacatttgtgtatctatttactaagcattttttatgtgcaggagagagtacaaaccaacatgcaacatagtcttcattcttaaaaagtacatagtaaaggtatgaaaaacatttgtattcagagaattctaagacaaatggtcaaatattcaaatggcctggcactagtggtaattccagcagacaaacagcatgagaaaaggccgggagacagtaataaatacgtgcccattgcaatgagttacccaatcaagcccttttacctccttaagatggcagattagaagaccctcttccccaggagagtgggagcgtctgccttcgggctgtcagtaatattaaataagagtgcttgatttataaattttaaaaacataagaaggtttgacattctgcccagagcaacggagggcagcgtggtttaccagcgaaaggactgaacagagtgccaggagcccttagctctagacttactgaacagaaagaccttgggtgaacttttcattgaaacactgaaggctttaggttcatacctgtatacgaaggatagtcctggtgtggggcagcagaaatgccactgagctagaagctggaagacccaggtcctggctttgctaataataatgacatttattatgcactgtgtgctagaggttgttcttaaacgtatgagctcatttagctcccgtgcccacccaatctctgtgaggaaagctctattcttatgagcatttaatggacaaggaaactaagccacagaggtgtgaaatccctttcctaaggccagacagctaactactgacagagctggaattctgcctggttggttgtcggcataacccatgttcttaatccccgtgctgctgcctcccaataaactgggtgagtgatcctgggcaaaagacaagctctctgcatttcagtttcctcttcagtaaaatgaggacatgagtattaataacttgccaaattaccttaaacagtgattgtcaagatctaaataagacattggatatgaaatactttgtgatatagaaagtcctatacatgtgtgaagtcttttcctcagaggaatgatgaaaagatgaaatgagatggctgatgggaaacgctctgggacatgaacataaaagtgcaacctagatgatcagtgccaccaccatcctgggaaaagctaactggcggtgagcaggctcttggactccatgaaaatttaaggatgtggcttctttttcatatctgtatggtatctttactcaacttgattttggcaggtttaaagaggaaaaatgaaggataggaagtttttatcctagaagcctagagaaagtgaagtatattcctttcaagaagagaatccccgggtttctttcctttcttccttccttaaattgagacccaaatgaggtggaagaaaatctctactgagatgagatgcatttttaggacaaacatggagaccatcatcgttgttccggaatctggccatgtgctaagagacagcttctgctccctatctgatattaccaagctggacagcatcttttctatgatccagttcaacttctttgtatggaagaaactgaggtccagggaagtgaagagatcggtccaagatcactggaacccatgactacaaggcagctcttgcgatgccaggcaaatgtgtgttcctccccatttcactgcctttcctttgggtggctttggggggagtgaaatttttatgagaacccacatcataatcctgtgacaatgccaaagaacgaaatgattttttaaaaaatctcttctctgaaatggcttctctgccttcatattgcctgaagagttaaacagacacaatctggatgagtctcaaagatagtaagaatcacctgttttctcgtggtaagaaggtgcttccagaaggctgatttttcacttctcatgccttcccttttcacacactgggggcagacactctctcctactgacaggaagagaattagcctcctttggtgttactgctccttcccactttagctcagcattatacacacaaaacgggtgggtgcggagccctttcaccaggaactgggttgcaaagtctgttagtggaaaaaaaagcaacacccttcttgagcccgtaatttatcagattttttttcctgtggcgatacagaggccccttcaccccagcaaccaagaggctacagctggatatgtgcttatgagatgggtcatagttaagagctgccagcctggggtctgtttctgggacatttccaccttagattagacaggcattggagtcaggagctagctggttactgtagcaacaggccttcaaagcttcacatttcaaatggaagctgctacgctatgaaacttgctcaggacaccctttttctcagtttgaggttaagtactcctccgcccccaaccccccgaccacaccccatgcccagtatactcttagagcagagaggaggtctggaggagacaagggcctaaggcttcacccttgctcacttggaactaggcattcttgctgtcatctggtttagtcaagggggttgtgaggcgtgtgggctccattgtgagtgtaggaaagatggaaagaaaattgccagatggggatgaggattccaagcctatcaggaggaaagaaatatgttactcactgccacaagaaggttgccaacgtcatttatggatcagcaactgcttgtaggcaaagtctgttacatgcctgtcactgggctatgcacccgaggatggaggcactagctgaggcttacgagttagaatagataaggtgaaaattgtctgccatggtatatgctggaaaaactctgggaaacaagacaatctgcctccaagggattaacagcccagtagggaagacagaccaacaggcaaaccctaagggcgggttagaaagaagcttgactagtgtaggtgcttcaaaatgaagacagctgtgtatgtctcagtcaagctgtgcgggtccagccaatttaagataaactctgtttaattacattttacgttttaaaaggaaacttcttcattacattgcctatcagtgcagttaagtaaaaaggcacatggaactatatgaacagatgccattaacaggtttttgcttttacatgtcatctttcccatttgagcattaattactcagtattttctcatcagttttcagaaagtttttcgaggataaacttgtagagggatttggggagaggaagctttattgggatctctaggggctattttatattttccaatgtctgaactgtttttacaacagattttccacagaaagctcaacaagtcactaaactttctgagtctcagaatctgggacttaaaatcaggggaagagatgtgaatggctaaactttctagttgtgtgaatagtttgcaacatataaagaattggtcaaaatgtttattcttagggtcggtagttattctgacttcacagaagggaatatctggccaactttcctcacagaatatcaattgtggaatcaagtatagggaatatcatgcatttaaggttcacatatagccttaagttgatgtccatattgatttaactatcaaaaaggcaattagattagtggggtagccaagtcacccacaaagactgatgagctgatatagaaaaaaaaaaaggaataaagaaaaagcaattgtgaagttccataagaataggagaaatgacagatatgaagagttttttgaagaaagtttcttctctgttgctatttagttttaacaaaggagtttcagaaatgaacatagagaagcaattgggtgaggctccctgctagatgaagaaaacttctatcacttgggaaaaatccacagaaatcctaatcctattaaaaacttaggtcattccaccccaacagtactctttcttccatgtccaaaaccatacgtggagcttgcttgtgtttcaatacaagctcttgcctcagtcctctccagattgctaaaaggaggtgtataaccctgctcttcagcagaaagaccgcaggtattcccgccgcatccacatatgcacacttacttcccttggatgtgtggcaacgagctctgctgctgcaagtgttatatgccatccgcaaacccacatgggtgcagggtgcacacctgaacagggggtagcctctgatgaaacatttgagtaatggatttctttacctcacctaaacagatccactgaaaaggaaactttttgggttcccacccacacgcaagatgtacaaagctgtctggggcaggtctggtacagactagccagtgccctccactggaataagtggttaatctcaaagaggtttacggtggtttctccacatatcttcacccttcaagcctttccataaaagtcaccagcaccctgtctctgggatgtggaaggttgggagaaaggaatcaacaaaatgaaagtaacagtatcaagatccagacttattcacaaattttgcctcttaaataaacataatctttaattaagtaaactttaatatttattttgtacctatcatgcactaggtatatacatatagttggggggggggcataaggacataataggactaaaaaagataaaagatatgttcgttgcccttgaagaattatagtctcttactgaggacttcatatacatgcacattgactagagaggcagtgtaaataactgaaaagaaagtgggaagagttttggctggtgcaatcagacagtgcttcttgaaaatggaacttgaattggtccttatgggcagaggtagcctacttgcccagctggagaagagaaggtaatctaccacgtggaaggaaggacatgaacaaaaaaatgaaagcaggaaggaacatgctggtttgggcagaataaaaaatccctagatttttttggaagtttctcgtctaacctcctgcctaaaccatctataatacattctgtccccaagaaaatgctctactgccaactaagcccatgtgattctcctagagatgcatgagtccttaatgaaagctgccctcactattcttgaaaaagccacttgcatttatagataacagagggtaaactttaaacacaactgcataaagtggcaaggaactggcctgccgtcagctcactgaatttggattccatgcaagcaggatgtgtaaaggaggtaaactccaaaagtgtttttcctcccttaataaggtctattcttcttggtgtcaaggtatgaaaagcagtatttcatatcaacgttcatggttaatctttttgatagttacaggagcaggatgattcttcacccaggggcacgggcaaaagggctgattacctatgctcacaagtcaccaaatccagttcaacacagtataaacaagccattgcttctgtcgacatttgagtccttttgtctgcaatcagggagttctgtgtttatctagctacatctttactctcatgggttaatcaaagtttctggaagtaatcacagccaactcttctttgcttataacagggtgcagcagtaacatggaacataaggtgggaaaaaagacaaaagtgtggatgattcatacattattcacaaacttaccttcttaatcactacaacactttaatattaaaattagcttacacttcctaaacaaacactgactggtgacaaagggattgggttaaaaggagcagataatgtcacttcaagaaatgttttctaagtttggatcttgattactgttaccttcgttttgtttttttaattctcccctcctaagcttccacatcccagagatggtgtgctgggggctttcacggaagcgcttgcaggtaaggcttggagaagtgaagacaggtggaaaaaccaggtttcatcaagctgttgaagagacatcaaagccaggagtaattctctgcatcctgtcacatgcttgtttctgcctccaagaaagcagagttaaaatggactttcagaccagagacaggtgaggatgacagggaggcagtgcaaaggctccgcaagtctgaaaatagcatagtgtgtctgccaaggtctgcgggtgcccaaatttcccccaccgcttcacggtggccttggctttacacactgttgctaccaagtcacagaaggaaaaagattctgatgattttcacttgtttcacgcttgacaattaaaacattcttctggatttcctttttttttttctctcttaaaccagtcaatgttgtctttgtgtaataagaaatatcaggtaagtcttaggatgtggacatcatgtttggggcaatgtctccctcaccgcctctctcatcctttataccataaaagagtgatggcaatatgctagctgaaattcacccttcgatggtttcattttcttgtctacaaaggcagggtgagcgactgctgccctgtgatttctggcactcccagtggaaaggaagcagaggggccaagttatggcagagtgcgcccagttaggccttcgactacaaaagtatcatggtttcccttcctccccagttaccattctttccctggttcccatccccttccacatccagcagtgtgggctaaccttcctttcctcatcctgggaaaacacatcttgctccagtgcaaagttagattggacaaacagccggtgtggagggggctgtgggaggtacggcttgccaggacaacttggctgaatgggttcctgaaacaaggcatctccaaatgctccctgcccctcaaacagcagaggagtgtgataatcatgctgtcaacatttttagagcatagcacttacacttttactaggcctcactccggacctattgaatcaaaatttgcattttaacccgatcccacgtgaatcacacacacattaaaatttggtaagcagtattctaactcactagaccgcaggtccacaaactgactcatgggacaaacccggccagctgcctatttttgtaaatcaagttttattggaacacagccacacttgtttatgaattgtctacaactgtttttacgctacagtggaaaagctgagtagttacaacagagaccatactgctgcaaaacctagtatttagtctccagacctttacagagaaagtttgctggctcctatactagactgtagactccttaaaagtgagaacctgatcttgttctgctttgtaaggtagaagggcagtttagtatagtggatatactacgtagactcagaggcagattgacatggtttgtatctaggctctgccactcccttgcaaatgactgtgggtaagacataaccactctgtgcctcatgttccccacctagaaaatggggatatattagattggtgcaaaagtaattgcattaaaatggcaaaactccaattacttttgcaccaacccactacatcagaacctacctttaagggttgatttgtgggttaaataagtgaagatatgtaaagactttaagtaatgctctcagaagatgttaactattagctggtaccaggcattttgggagtagataggggatctgctgaatgttggcagaatgacccatccctagagcagacattgtctatcaatacccattctctgcttcttccttgctaacatcaattatttctgtagatatctgaccttcatggaagatgacctcatctctgggggaaaatactattgaaagccaatcacaatgccattctcagtgtcagtggattggcatgaggtgggtggttctagccaatgagtcataagaggttttttgttttttttttttttatttggggtctcactctgtcacttaaggctagaatgcagtggtgtgatcgtagctcactgcagcctcaaattcctgggctcaagtgatcctcctgcctcagcctccctagtaggtggaaccacaggcgagagccaccatgccccgctcattttttatattttttgtagagacagggtcttgctatgttccaggctggtcttaaactcctggactcaaacaatcccccaaccttggcctcccaaagtgttgagattataggtgtgagccgctgtgcccggcctagaagaggattcttgaaggacttctgggaaatggttccttcattccttagaagaaaacacagaagagatgctcctgttcttttatgaatgttatctctgggtgtgatgcctgaaactgcagcagcaggaaggcaggcagtctgagagcacagctgacctaattagaatggcaaggaagaaagatggaaagaattcaggccccttaagaggtctcagagttgctgaatcaccaaactcctgggcttacctactcacgtactaatgttatgaaataaaataaattttcctcataatttaattcttgtccagagcatcctgattcatatagccagggaccatagttacacatatttttacttcctccaggacctaacaactggtgttgtgtgctatgagcaaaggaagagcagtagctggaaatgaataacctgggtaggacacaggaagactcaaaaatgttctaggctatgcaaatcaaaaccatgagatagtaatatcacctaataccttttaagatgccattatgaaaaaacaaaacattacaagtgttggagaggatgtggagaaactggaacccttgtacattgttggtgggaatgtaaaatggtctagtcactatggaaaacagtatgaaggtcttcaaagaattaaaaacagaacaatatatgatccagcaatcctacttctgggtatttatctaaaataattaaaagcagggcctcgaagaaacagtcacactcccatgttcactgcagcattgttttcaacaatcaaggcgcggagccaacctaaatgtccctcaatgaatgaacaaagaaaatgtggcatagccatacaatggaatgttttcagccttaaaaagaaaattctgtcacatgctgtaacgtggatgaacctggaggacattatgctaagtgaaataagccagtcaaaggacaaacactgcatgattccacttatatgaggcgttcaaagtagtcaaactcacagaagcagaaagtagaacagtgattgccagaggctggtgggaggggaaacgaggagtggctgttcaatgggtataaacttttggttatgcaagatgaaaaacttgtagcagtctgctacaaagcactgtgctgcttctagttaataatgtaccgtctcaaaataaataaataatgtactgtacacttaagagggtagatctcacattatgtgtttctttacaacaataagaaaatcaccttgtaaactggaaatttccaaaatggaaattggagtagcttgtattgattttaaaatttatacatgctctcactcataggtgggaattgaacaatgagaacacttggacacaggaaggtgaacatcacacactggggcctgttgtgaggtcgggggagggggaagggatagcatcaggagatatacctaatgtaaatgacgagttaacgggtgcagcacaccaacacggcacatgtatacatatgcaacaaacctgcatgttgtgcacatgttccctagaacttaatgtataataataataaaaataaaatttatacatgctcctaggc

SEQ ID NO: 225 - DNA, 10000 bp, Homo Sapien
gagcatgatcaaaggaagagaaccaataaaggagaggttggggagcagtcagagaagcagggcacggggggcgggggatgccaagcagagacagggcagccatgtttgaggcttcaaagaggtctagtaaatgagggttgaaaagattgttgggttcaggaactagacgattacaaattttgagaaaaccgtttccatttaatagaggggcagaaatcactttacataggttgaggaatgagtgggaggtgaggaaaaggaggtggtgggcatgaggtcagaatggtgaacacagaataactgagaatcatctcttagttctacccacagattttacagttgagggaaattttaccagttcctgaaaaagtggttcgttaagggggctagtcttttgagacatcacacgaaaacggaaggtgagatagactggacatttgagggagaaatattccaaggaaggatcttttttgttgtttattttcaagaaataaaattgaaggtaaaatgaagatgcttaaagagacaaagataggccaggtgcagtggctcacacctgtaatcccagcactgtgggaggccaaggtgggcagatcacttgaggccaggggttcaagactagtatggccaacatggcaaaaccgcatctctacgaaagatacaaaaattagccaggcgtggtggcacatgcctgtggtcccagctattcactgaggtgggagaatcgcttgaactcaggaggcagagggtgcagtgagccgagatcacaccactgcactccagcctgggtgacagagcgagactcagtctcaaaaaaaaaaaaaaaaaaagcccaggtgcggtggctcacccttgtaatcccagcgctttgggaggctgaggtgggcagactatagatatcaggagttcaaaaccaacctagccaacatagtgaaatgctgtctttactaaaaatacaaaaattagctgggcgtggtggcacacgcctgtaaccccagctactcaggaggctgaggcaggagaatcacttgaacccgagaggtagaggttgcagtgagccgagatcgcgccactgcactccagcctgggcaacagagcaagcctatcccaaaaacaaacaagaaagggagagatagtgaaaacataagcaagaagtggggagagaatatagtaaagatagaggaagtgggatagagtacagataaaaggatcagtcttggaaacaagaaaaagtactgtgagtcagtatgtaaggaaagattaaatataacaaaattaaggaaaaagagggaagtgagatccacacttgatggccttaagctcaatgaaatattaatagatgagagtgaagaacatcagaggcacggagatttagaacatcacgcacagtagtataatggggagtcaacaaagaatgagtaaaagttgtgtccaagaacactgatgactctctgagattagctggccaggattagttataggcctcttatggtgactcagctgtctactgcagcgcttggcagcctaagacaaagccccaagaatgagaccacttagtttacccaagtcaatttttgagacagagtttcactcttgttgcccaggctggagtgcaatggctcaatcttggttccctgcaacctctgcctcccgggttcaagcgattctcctccctcagcctccagagtagctgggattacagttgcccaccatcacgcccagctaatttttgtatttttagtagagatggggcttcaccacattggccgggctggtctcgaactcctgacctcaggtgatccgcccaccttggcctcccaaagtgctgggattacaggtgtgagctacggtgcccggcggtaagagattctaaaatgcagacaaagtggagttgaaattgttgaccatgcagtacatgttaaatcaacaagcaaaaccaggaaagcagaagcagccggaagtcttggtaagaataaagaactgattcaaggggaggcagagagtgggagatgtgaaaagtgagtggttgtgatgagaagggtaattcagagatcaagatcttgaaggcataattcttccaagtgatgctggggtttgaggtacaaccttactcctgggtggctaaaatggaggagggaagaagaggctgtaaaaccagtagacttgagaaacttggagaattgagaggccagactgtaagactcatctgatctgtgtggcttctttttttatttttatttttttcctctgagacgaagtctcgctctgtcacccaggctggagtgcagtggtgtgatctgggctcactgcaagatccgcctcccgggttaatgccattctctcgcctcagccttccgagtagctggggctacaggcacccaccaccacgcccagctaattttgtttttgtatttttagtagagacggggtttcaccttgttagccaggatggtctcgatctcctgacctcgtgatccacccgcctcagcctcccaaagtgctgggattacaagtgtgagccactgcgcccagccgatctttgtggcttttaaagtcactaaagatggtggtaggaggccgggtgcggtgggtcatgcctgtaatcccagcactttgggaggctgaggcgggtggattgcttgagctcaggagttcaagaccagcctaggcaacatagcaaaaccctatctctggaaaaaaaaaaaaaatacaaaacttagccgggcacggtggtatgcgcctgtagtcctagctactcaggaggctgacgtgggaggatcacttgagcccaggaggtcgaggctgcagtgagccaagatcacgccactgcactccagcctgggtgacagagcaataccttgtctcaaaaaacaaacaaacaaggatgatggtagggataagatgtggagaaagactgagctagttatacaagttgttaagagcataataaatattttgatggataagattgtgctgtgaagacaggaagagcatggcaaatgcaaaaggcacgtgctttgggagatgaggaggagtttatcagtggtctgggggagagaaaataacgacccctctcttctgccttcattcccctagtgatggaggtcgaagaaagagcaaccttcaccacagagaggagtagcatcattaggggaaagccaggtttcaaaatgcccagaggaaaatgctttcaaacatagaagacaggatttgaaaatgtgaagagttccaccaaatattgtgaaatggattggtagaagggtccttgtggggtagggaattgaatccagggaggttaaatcccagtgggaattcagaagactaagtctggagagtttagcttctaggagcaggaggttgttgcctctggaattcagaatggaagatgcactgcatccattgtgaggggaaacaagtgcctcaaaggggtcttatagggatgcacaagataagttccatggctttaaacaccatcctcatgctgaccatgcccaggtttctttctctagcttggaccttgcccctgaaatccagatgtgtatctgcccagtggcatctctacttgcatgtctaatagacttagacttaccacacccaaaatagaattttttagtttttccatccatcagaatcctgcttctctcccagtatctacatctcccacccatcaatccatcatctagtcctgttgtttctacccctggaatgtataatatatcccaaacttgtctacttctctccatctccatggctgccactattttctcttcaccatcaatgccactgccacctgtctcctaccagccagcctaaacacaggagccacagtgatcttttaaaaacaagtccaggctgggcgcgttggctatgcctataatcccagcactttgggaggccgaggtgggtggatcacgaggtcaggagttcaagaccagcctgcccaacatgatgaaaccctatctctactaaaaataccaaaattagccaggcacggtggcgcatgcctgtaatcccagctactcggggggccgaggcaagagaatcacttgaacctgggaggtggaagttgcagtgagccaagatcatgccgtagcactccaacctgggcaacagagcgagacgccatctcaaaaaaaaaaaaaagtccaggcaaggctcagtggctcatgcctgtaatcccaacactttgcgaggctaaggtgcaaggattgcctgaggccaagagttgaaggctgcagtgagctatgatggtgccattgcactccaacctgggcagaaaagtgagactccatctcttagaaaaaaaaaaccaggccgggtgcagtggcacatgtctgtaattccagcacttcgggaggctgaggcaggcggatcacttgaagtcaggagttcaagaccagcctggccaacatggtgtactttctatactaaaagtacaaaaattagccaggcatggtgacatgcacctataatcccagctacttgggagactgacataggtggattgcttaaacctgggaggcagaggttgcagtgagccgagattgtgccactgcactccagcctgggtgacagagcgattctgtcttaaaagaaaaaaaaaaaaaaaaaaggctgggtgcggtgtctcacgcctgtaatcccagcactttgggaggccgacgcaagtggatcacctgaggtcaggagttcgagaccagcctggccaagatggtgtactttctctactaaaagtacaaaaattagccaggcatggtggcatgcacctataatcccagctactcaggaggctaagacaggagaatcgtttgaacccgggcagcagaggttgcagtgagctgagattacgccattgcactccagcctgggcaacagagtgagactccgtctccaaaaaaaagaaagaaaaaaaatccagggccagtgtggtgactcatgcctgtaatcccaaaactttgggaggctggcccagcatggtggctcacacctgtaatcccaaaactttgggaggctgaggcaggcggatcacctgaggtcaggagtttgagatcagcctgactaacatggtgaaaccccatctctactaaatacaaaaaattagccgggaatggtggcatgcacctgtaatcccagctacttgggaggctgaagcaggagaatcgcttgaacccaggaggcagaggttgcagtgagatgagatcagtcattgcactccagcctgggcaacgagcgaaaccgcctctcaaacaaacaaaaaaaaactttgggaggccaagatgggcagatcacttgaaaccaggagttcgagaccagcctgagcagcatagaccctgtctcaacaaaaattttaaaatattttttaaaattagccaggcacagtggcacacacctgtagtcctagatacttgggaagctgaggtggaaggatgacttgagcccatggttttgaggttgcagtgggctatgatggtgccactgcactccagcctaggccacagagcaagacaccatgtcaaaagaaaaaaaaatccaatcacctctgctcacctccctctttctctctctctctctctctccctccccctctctcccctgcaacacacacacacacacacacacacacacgcacgcatgcacgcaccacacactctgacgacctttaaaggcttcctgtggctggatgaaatctagaggctttacccttcttgcatggccctgcatgacctggcccctgccctcctctctgacctcatctcccacccgcctcccagtctctctctctgctccagccacactggccttctgtttgtcgtcaacacccccagcttggttccgccttccagcctttgcagtagctgctccctttacctgaaatgctttgctcccaaacttttacctggtcactattttttgtcatttgggtctcagctccagtgccacccaaacactcaaagaggattttgctgactactgtatttaaaagtagctccctgccactcttacaacatcagcctgtcttattttctcatagtaccaatttcttcttcagtttctttcttttccgtctggcctcactggaatacaagctccacaggtgctggtaccttctctgatccctttgcctccatgtccctcctgccttaggacaatgcccagcatgtgttaggcacgcagatactcactaaatggaggaatggatgaataattcataaagcaggataaagttcaactttaggcttgtggctcagattggacttacatttagagtcagatttaagtttagtgttaggagtggtggtaaactggtttcaagattagccctagaaacagggttgggttggggtagaggagaagttttatttagggggttattaattgggatgtgtttagatttaaggttagggttacagttggggttgagtttgagttgtgatttgggttgaggttaaatttgggttagggttgatgttggtattaaatcccaattcaggttttgaggctaagttcaagtttgaagctaatgtcatttcagtctcatttggaggcttcagagatttcactagtttctccacaaagaccactataaagactgtatttccctgagtctggggcacaagactccagtcatcagctctcccacccagggaaagtcccaaaccaactgctggcctgcccaagaaagaaaccaaattcatacaacctccgaaactgagattgaaaccaagattggcccatctcaaggagcatccttcgcatatctcacatgcacgtgacactgagcctcagcccagtcttacccttccttcctctgtgtctctcatgtctccccatcacccttcttgccttcccttttttgtctttcaatgtcccattcttcctctttaatttaaatttctctctgtgtctcactgttaattgcaatacctttttttgtttgcttgttttgttttgttttgttttttggtttgtttgtttgaaatggagtctcactttgttgcccaggctggagggcagtggcacgatctcggctcactgcaacctccgcctcctgggttcaagcagttctcctgcctcagcttccctagtagctaggattacaggcgcgtgccaccatgctcggctaattttttgtatttttagcagtgatggagtttcaccgtattagccaggattgtctctatctcctgaccttgtgatctgctcgcctcagcctcccaaagtgctgggatgacaggcatgtgccactgctcctggccttgtaataacattttatattttaatatagctcagctggggtcccagtccatcagctcataccattagagaagcagaaagagacaacaggaagcaaaaaggaccctgagagaaagggcaacacagagaaaaagaaaggagcaggggctaaaagggaaacccacactgacacaagagataataaggttaaaagaatgagaagaaggttgggcgcagtggctcacgcccataatcccagcactttgggaggccaaggctggtgggtcacctgtggtcaggaattcaagaccaacctggccaacatggtgagaccccgtctctactaaaaatacaaaaaaaaatttggcgggcttggtggcgtgtgcctgtaatcccagctactcgggaggctgaggcaggagaatagcttgaacctgggaggcagaggttgcagtgagccaagatcgtgccactgcactccagcctgtgcgacagtgagaaactgtctcaaaaaaaaaaaaaaaggaaaagaaattttctgacctatctcatctgatagtaggttataagaccctcattccagaagaggttctgccctatacctgggaggaaggaatgctgtacagagagaccaagaagaatatggccaggccttgctgggatccccccagtcccagtctgtgaccattagatgatactccttttgttcaattacatttctgcacagctgttcattcttcatcaaatctaagcataaaaatagttttcccctgggtccttgggtcttcatttctgaaggctcccatgtcacctaaaactttgattaaataaatgtattatgcttttctcttgttaatctgtcttttattataggagtattggccataacccttatgatgggtcaggaagggatcacccctttctgcccctacagaaataatagctaagactagtaaagcataaaaggcaaaggggcaggtcctcaagtagagaagaacaggagaaatagctcatacacacccagaatgttacttacatgtccctccatgttacaccaagacccctcagggaccttgtgcctggggagagaagtggtctgccccatgcaacagtgggctttaccccgggtcaccaccagccccagctccaacccctctaacactctccaagtaaaatcacatcagtagcagtaataatatttgaggtgacaagttggtattatctcaaacttaggaaaagtgaataaagtcatctttagaaactgctttttttaaaccttgtaacttgcaagctaagtgaaaatgggctcatgtatgagaatgttcgtgttagacattttttgtgttagacaaaaactagaaacaaaccaaatccccatcaacagaatatattagaatatattgatacaatagaatattacatcataatttttttaaaaaacattactgatacatacaaccacgtatatgaatctcacaaacataatgctgactgaaagaagtcaaacagaaatgagtacattctgtgtgatttcatttatatgatgccccaaaccaggaggaaataatctatggtgataaaagtgagagagtggttggttatctttggagggtatcagcagggagggggcatgagggaacctgctggggacctgaaaatacgtggagctgggtggtggctacatacagatggaaaaattcatcagctgtacacttaagaggtgtccacctcatacctaagttacatatcaataaaaaggaaaaaaattttggaaactttttttttttttttttgagacagagtcttgctctgtcccccaggctggaatacagtggtgcgatcttgactcactgcagcctccgcctcccaggttcaaataattctccagcctcagcctcccgagtagctgggactgcagatgcgcaccagcacgcctggctaatttttgtatttattatagagatggggtttcaccatgttggccagctggtctcaaactcctgacctcaagtaatccgcccacctcagactcccaaagtgccaggattacaggtgtgagccactgcaccaggcctggaacaattttaaaataatgtattggctctgcaaatgcagcttcagaacaagtcccttagctgtccccaccccaccctaagtcaccacccttaagcctcacccatgtggaattctgaaacttcctttgtagaaaactttggaaggtgtctgccacattgatcctggaatgtgtgtttatttggggttatataaatctgttctgtggaagccacctgaagtcaggaagagatggagggcatccttcaggagtgagatgagacctcatcatacttgactgtccagcatcatctctgagtaaggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaaccacctcctctctgaattgactgtcccttctttggaactctaggcctgaccccactccctggcc

SEQ ID NO: 226 - DNA, 10000 bp, Homo Sapien
catggcaacccctggacacagttctgaaccaaatgaagaggatctggaaggcaaagcactaagatcatagtgaagacttgcctcccccttctccttgtgtcccaccagcctccctgctggcctgaccaggccccatactccagtctccccagagaccccaagctgaagattctgtgggtctgccccattgctgggcacagcagagcctggatggaggcttgttgtcttctgcagttgccccaaaggttgctcttgctgggggcagccgccctgactgcaactgctttggagacaggtaagtatcagggggcttggttggggcacccagaagacttgggcccccaccatccttagagactatgtttccccagtcagcactcatcctgctgggctgagaccttttgagctgggggaggctgggaaactgtgtctggtcttgcttggcatccccaaatccaacccaaagccttctggaaggcttggatctgccagtcacctagaagcaggagtctgggagtgggcaggacagccctcagggcctgctttgcaaaactctgtaggcttcggattcagagaagctgcatttacacactctgccacttcttatgtttgtacctttgagatcattgtttcaactctctgaatttctttggcagtaaaatgaaaataataggcccttgccccttaagggactatgattattggcatataagatgagataagtcatgcaaggcacttcataatacctggcacataaaaggtgccaaattcccggctgggcgcagtggctcacgcctgtaatcccagcactctgtgatgccgaggcgggcggatcatgaggtcacgagatcaagaccatcctggccaacatggtgaaaccacatctctactaaaaatacaaaaattagctgggcatggtggcatgtgcctgtaatcccagctacttgggaggctgaggcaggagaatcgcttgaaccagggagtcggaggctgcagtgagccgagattgcgccactgcactccagcctggcaacagagagagactccgtctcaaagaaataaaaaaaaaaaagggtgcccaattcccttactctctaaactccatgcctgccctgtgtaccttcagggtaggctctggctttagcagagaaataccaaatattggaaagtgctcccacatcctgagctctgatgaaggattttttcctcaaagacccacatcctggctggtcctcaagtacccactggtccctatcttgcaccagaaaacccacctcctctttcctctctgtgcttacagaaatcagggctactttgagtacttgcacatcttctcatttaatcctcacaacaaccctgtaccagtgaggatgttttgggctgtaagtaacagataacaaactaaatggggcttaaatggtaggatatttgctatttcagttaagagtggtcataggtgattccagagatggttaactcaacggctcaacaatgtcactgttcctctgaaatgctctgacctcatctttgcaaaatggctgctgcagctctggacatcccatcctcatcctcagtcagcagctttcaaaagcaggaagaaaaggggctccttatcacacagctctccccctcccctttttttttttggtgacggagtctcgctgtgttacccaggctggagtgcagtggcttgatctcagctcactgcaacctccgcctccagagttcacgcgattctcatcctcagcctctcgattagttgggattacaggtgcgcaccaccatgcccggctaattttttgtattttagtagagatggggtttcaccatgttggccaggctggtctcgaactcctgacctcaggtgatccacctgccttggcctccaaagtgctgggattacaggcgtgagccactgcgctcggccccgcatcttagggtttcgaataagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggcggcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctctttccgtctgggtgagctggggctgaaggccgggacgggaccctctgcagaggccatgcgggactggggccacagtgggggccccggtgagggccgctgccgacaggggaatggcaggggtgcccgaagcacaagatggcagggactgggtccaacgggagggaagaaggtggtggctagtggcagagtcacaataagggacctcccggatcctaagagccaaccatataaatctggctaccatggatgtgtgcgtcagactgtcctaccagccccagtgcgcacacacatccacacacatccacacacaacttcctccccacacacattcacacacaactcccacacgttcacacctcacactctgacatccacacccatgtcacatacgcacaacccacgcacctcatcgcccccacacactccacactcatgcctctcactgcagcacacgcctcacactgcacactcaccatcacacacctcatatgcacacagtaccgccttgcacacttacacacagctcacatgctctcatgccacatgctggctgctctgcgctgggtcagcccttcagatgtttgcagaagggtgtgcttaggactcgccaggcctgtaggcagcagaaaccaactcaagccaggaaagggccctcttggaactgaaattaataatactcgcccaactgggcgccgtggctttcgcctgtaatcccagcactttgggaggccaagtcatgaggatcacttgagctcaggaattcaagaccagcctgggtgacagagagagacctgcctaaaacaacaacaaaaaataatttaaaaaatataataattaaaaaataataaaattaataacagtacttgccccataggggtattgtgaggcctcaatgggccaggatgtgtagtatttacggctgtgcatggcacagaagaggaagtcagtacatgttagctgccatcctccaccctcctccccatgaaacactcatccatgttctcatctgcatgcatgagggcagctctctcctgcccacacccccacactgtcaccatgggggccacacatcctgctgtgtcgtgggctggaccggaatcctcacctcaggcttctgcttctggcctcaggaccttgtggtgcctacttccgctgccagaatggcaggtgcatcccctcaagcctcgtgtgtgacccctggggcatggacaactgtggcgatggcagtgaccagggctcctggtcaccagctgactgcagaggtcagtgcggggtgtggactgggccctactgaacagctggagggaagcctggccctaactccccttccctagggcagggccccgatggggaggcaggagagaggaaagcggaagtgtggaatcggcttaggccaagggctggaggggcagagcagtcagggccagaactatgctgcagatgatctcatccggcggattccaaatgatgctttagtggtggaaacttttgctaaatgggacctggcatggaggcccaagacattcaaaggagatatcctctgcttaactggatggtgggcctggggccctggctgcctgatgtctctctgagggccctgagtgtcaccctcaagacatactttgaaaaccatcaatccagtctgattcccacactttacagatcaggaaactgaggcctagagagaagtgacttgcccaaggtcataaagccagtgagtaaaatgagcaggaatgatctctgtagacaggggagtgggataggagggctagggttggtggaagggaccagaacaaatcacccaggaataaccttcctggggatctaaagatgtcccacctgcccaccacacccaattaggagtgggatggaggtagggctgccatgtacagttgaacaggggtgaaatgcagtttcccagaaccccacacacttaccttccccatcccccgctcagccttttttgcaggttcctggtcatttccctgatgctgtatgctttgtgccatgagacccaggtcctatgtccccttgtcctccatccaggctcattcccttgtgggtctcatttatatcgtatcacctgtgggacttgtctttgaacttcagccacataacctcctccctgctcagcatctctgcgtggatgtataggcgaaatctcaaacttaacttgccccatactggactccttgtccacagccctccctgcatcctgcttccctctcgctgagcagcgacttcacattccagctgcccaggcctcactgagtcatcttttactccccgcttaacccatagcctataacccataaccaagccagtgacaagtcctttgaaagctctccagactctgacccttctcacacctgctctgccatcacctggtctgagccaccaccagctctcgtctgggttgttctaataacttctgaactggtctccctccttctgtcctttgcctctgacaacacaggaagaaggaagcctgggggagccttctttttctttttctttttttcaaatgaacttacttatttattgttttgagataggttctcattctgttatccaggctggagtgcagtggcgccatctcggctcactgcaacctctgcttcctgggctcaggtgatcctcccacctcagcccccagagtagctgggaccacacatgcaccaccatgcccagctaatttttgtgttttctgtagagatgaggtctcactgtattgcaagggctagtctcgaactcctggactcaagatcttcccaccttggcctcccaaagtgctgggattgcatgaacttcattttttagggcagttttagatttacaaaaaaattgagaagatagtacagaaaattctcatatacccagcactcagtttgggtgctattactgacattttacattagtatgagacatttgttttaattaatgaagtaatattattaactaaagtccacagtttgttcagttttccctagtttttacctcatgtcctttttctgtcccgggatcccactcagcatctcatgttacatttatttatttatttattttattactttttttcagatagagtcttgctctgtcgcctaggctagacagactgcagtggcgtgatctcggctcactgcaacctctgcctccctggttcaagcgattctcctgcctcagcctccggtgtagctgggattacaggtgcacaccaccacgctcagctaatttttgtatttttagtagagacgggatttctccatgttggacaggctggtctcaaactcctgacctcaagtgatccacccgccttggcctcccaaagtgctgggattacaggtgcacaccaccacgctcagctaatttttgtatttttagtagagacgggatttctccatgttggacaggctggtctcaaactcctgacctcaagtgatccacccgccttggcctcccaaagtgctgggattacaggcgtgagcctccgcacccggcctcatgttacattcattaatagtcatcatgcctctttaggctccccttggctgtggcagtttctcaggatttccttgtttttaatgatcttgacagttgtgagtactgctcagggattttgtaggatgccccactattgggatttatttgatacttttctcatgaaaagactagagttacagttcacagaggtgaaatgccatcttcatcacatcacatcacaccaaacatgactttggtgttgggtgtttggtgttggacggtggttgacgctgaccttgaccgcctggctgatgtctgcctcatttctccaccgttacttttggtcccatctttccccactgtattcttgggaagtcactatgtatagcccacttgagtggggagttatgcttccccgccagaggtaccttttaaaacagtaaatcaggttatgtcactatcctgctcaaaaccctcatcacattcagcaaaggcaaagcctcgcccgggctcaaaggccctgcacgatctggccctgccccttctttcctggcctcgcctcttccttcctggccccgccccccgccccacccctccctggccccgcctcctccctgccccaccccctccctggccccgcctcccctccacactccagctttgttctggcctttgcagtagctgtgtcctctaccagaagacttttcttctgagatctgcattgcaagctcgttcctttgcttcctggtgggtctctttaagttcttccctgactcctttatataaaaatagcaaccctggccaggtgcggtggctcacgcctgtaatcccagcactttgggaggccgaggtgggcggatcacctgtagtcgggagttcgagaccaacctgaccaacatggagaaaccccatctgtactaaaaatacaaaattagctgggcgtggtggcatatgcctgtagtcccagctacttgggaggctaaggcaggagaatcacttgaacccgggaggcataggttgcggtgagccgagatcgcacggttgcactccagcttgagcaacaagagcgaaactgtctcaaaaaaaaagttattattagtaacttattattatattctaatatgtatattagatatgcttcctgtacagcctgcagaactgagacaattaaacctcttttctttataaattacctttataaatttataaatttataaattacctttctttataaatttataagaaaattataaattttctttataagcatatacatatgtatattagaatagtcaaaatcacagagacaggaagtagagccatggtcactaggggctgggggggtggggacaaggaggatatggagttaatggaattgacggagttgatggagtttccgtttgggcagatacaaagttctggagatggatggcggtgatggctgcacaatgtgagtgcgtattagtccattctcgcattgctataaaaaaacacctgagactgggtactttataaagaaaagaggtttaattatctcacagttctgcaggctatacaggaagcatgatgctggcatctgctcagcttcaggggatgcctcaagaaacttacaatcttggcagaaggcgaggggagcaggcacagccagagtaggagcaagagagagtgagtggggaggcactgcacacttttaaacaaccagatcttgagagaactcactatcttgagaacagcaccaaacggatggtgctaaactattcatgagaaatccacccccatgatctaatcacttcctaccaggccccacctccaacactgggaattacaatttgacctgagatttgggtgggaacacagatccaaactctatcagaatatatttaatgccactgaactgtacccctaaccatggttaaatggtaaacgttatgtgctttgccacagtaagaaaagcggcagcccgctgggcgcggtggctcacgcctgtaatcccagcactttgggaggcagaggcgggaggatcacgaggtcaggagatcgagaccacagtgaaaccccgtctctactaaaaatacaaaaaattagctgggcgcagtggcgggcacctgtagtcccggctactcgggaggctgaggcaggagaatggcgtgaacccggaaggcggagcttgcagtgagccgagatcctgccactgcactccagcctgggcgacagagcgagactccgtctcaaaaaaaaaaaaaaaaaaagaaaagaaaagaaaagcggcagccctgcccccaccaacatgcgtaatttttctcactagcatctatctcctttagacataaattctattcatgtgttttgtttctccccacactaaactcccagtgccatgaagacatatttgtcatgtgctcatggttgtatcccccagttgctagagccatgcctgggggcataggagatgctcaagaaatactagtcaaatgaatggaagaaggaacctctatgcctcagtttccttatctgtgaaatggggataaacctcacccttcagagttgttgtaaactgtgagtggcatacataggtaacgggcccagcacagagtgtggtgcttgatgcacagaaaatgctcatggccgggcatggtggctcacgcctggaatcccagcattttgggaggctgaggcaggtggattgcttgagctcaggagtcgagaccagcttgggcaacatagtgagatcccgtctctacaaaaaatagaaaaattagccaggcatggtggcacgtgctggtagtcccagctactcgggaggctgaggtaggaggatcacttgagcctgggaggcagaagttgcagtgagtggtgattgcgccactggactccagcctgggcgacagagtgagaccctgcctcaatgctcagtacatgtacaccctcttccttgggaagtagctccactcatagaccttaggccctggagccagaccatgtgagttcaagtcctcctatcacttccagctaattgaactcggcaagtgacaacctctctgtaaaatggaaacacagagtgacaaactcagggaagtcttgtgaggattgaatgaaacacacaagtgtcccagaaagggcagttctcagtgtgctagttctgttctttcccatgcaggtccctctccggtgcccagccagacaggaagtacagatgcccatacctccagatccctgactccctccccagctctcgggtctgcaggatccctctggattgcagctgagaggagttccccagcaggcagggaccccacgagacaagacgcagctttggaaggttacaccttgctcctactcttcccaccaaaatcatacctgtccctctctaggtgatggggacggggcagaggacccaggccgaggcctgagtggactttctcttcccacaggcccccagctctgaggggtggcgctggcctcctcgatgctcctggcctctgctggcctcctcctgggcctcctctggtgctgttgctctcccagctggctggcctggcaacctggtgcccgtggcctctgcctccactgcagcacagcctgtaccacgtgctacccatgtcccagccaggtctccccagggggctgcagttgagtggcccagccttataggatcagggaggccatccctagaggggcttcgggcacatgggaatgatactaggctctggggtcagactctttgggttctaaccccctggctctctgtctgatgttggacaggccccctaaccctctgagactcagctgcccctctagaaaataggacaattcctgcctcacagggttgggggcctgggggcctcgctgatcccaagccagcttgcttcacccccagatctcacctgccctgctctgccccatccacaggctccactgagtgaagccctcatcaaagactcaggaggccc

SEQ ID NO: 227 - DNA, 10000 bp, Homo Sapien
  misc_feature 4032, 4033, 4034, 4035, 4036, 4037, 4038, 4039, 4040, 4041,4042, 4043, 4044, 4045, 4046, 4047, 4048, 4049, 4050, 4051,4552, 4553, 4554, 4555, 4556, 4557, 4558, 4559, 4560, 4561,4562, 4563, 4564, 4565, 4566, 4567, 4568, 4569, 4570: n = A,T,C or G
  misc_feature 4571, 4572, 4573, 4574, 4575, 4576, 4577, 4578, 4579, 4580,4581, 4582, 4583, 4584, 4585, 4586, 4587, 4588, 4589, 4590,4591, 4592, 4593, 4594, 4595, 4596, 4597, 4598, 4599, 4600,4601, 4602, 4603, 4604, 4605, 4606, 4607, 4608, 4609: n = A,T,C or G
  misc_feature 4610, 4611, 4612, 4613, 4614, 4615, 4616, 4617, 4618, 4619,4620, 4621, 4622, 4623, 4624, 4625, 4626, 4627, 4628, 4629,4630, 4631, 4632, 4633, 4634, 4635, 4636, 4637, 4638, 4639,4640, 4641, 4642, 4643, 4644, 4645, 4646, 4647, 4648: n = A,T,C or G
  misc_feature 4649, 4650, 4651, 4652, 4653, 4654, 4655, 4656, 4657, 4658,4659, 4660, 4661, 4662, 4663, 4664, 4665, 4666, 4667, 4668,4669, 4670, 4671, 4672, 4673, 4674, 4675, 4676, 4677, 4678,4679, 4680, 4681, 4682, 4683, 4684: n = A,T,C or G
ttggctggataagtctcatcaccatgcaaacatctagcatccaaaaaaaaaaaaaaaaataggccagggagtttggctcaggccaactttatatctgtaagctctgcctcaatatctgtgtggagaagagtgacgacagactgacacaggcagccaaggtgttggagcaactcacaggccagacccctgtgttttccaaaactagatgcactgtcagatcttttgttttcaggagaaatgaaaagattactgttgactgcacagttccaggggccaaggcagaagaaatcctggagaaaggtccaaaggtatgggagtatgaattattttttcttaacttctcagatactggaaactttggtttccaggaacacaagaatctgggtatcaaatatgaaatctttggctgcgactttctttcttcttcttttttttttttgagacagggtctcactctgtcatccaggctcaagtgcagtggtgtgatcacagctcactgcagccttgaacttgtgggctcaagcaatcctcctgcctcagcctctggagcagctggaaccacaggtgcacaccaccacacccgggtaatttttttttctcttgtagagatggggtcttattatgttgccaaggctggtgttgaactcctgggctcaagcgatcctcccacctcggcctcccaaagtgctgggattataggcttgagccactgtgccaaacccatggttttatttttattttatttttgagatggagtcgctctgtcacccaagctggagtgcggtcgcacagtctcagctcactgcaacctccgccctccgggttcaagcaattctcctgcctcagcctcccgagtagctgggattacaggcgcgtgccactgtgcctagctaatttttatattttcagtaggggtttcaccatgttggccagggtgatcttgaactcctgacctcaggtgatccacccgcctcagcctctcaaagtgctggaattacaggcgtgagccactgtgcccggcccagcccgtggttttaaatacgactcccacatttgtatttctcaccttgacgtccctatcaagcttgagactaacacattcttggcaatctaataggcttctcaaagtaagcatgcctaaaatagtacttttttttttttttagacagagttttgctctgttgcccaggctggagtgctgtggcatgatctcggctcactgcaacctctgcctcccgggttcaagcgattctcctccctcagcctcctgagtagctgggattacaggcacacgccaccatgcccagctaattttttttttttgtatttttagtagagacgggggtttcatcatgttggccaagctgatctcgaactcctgacctcaggtgatcccccgaccttggcctcccaaagtgcagggattacaggcgggagcaaccacgcctggcctaaaatagtattcttaattcagtgcccacccaatcaaaaaagttgtaacttccccatctcagtcaatagcactatcatttagcacccagttacttgggtcaaaaacctagaaatcattcctggtttctctcttttttcttcctcacctccccagatcttccacctcttcctattgccaaccaaatccatggagaggcccacctttattacacacacaccccatcactctcatgctggttcaagtcaccatcctttctggcttgggtgataacaacctcctaactattctctctgcttcttctgttcctgcctcctagagtccattcccccaacagtcaaagtcagagcatatcattcctctgttcaaaaccctcctttggtttttcggtgtatttacaataaaatcaaaactccttatcatggctggcaaggtcctatcttcaggggttatcaacaatggctgcacattagaaacatctgaaggacttaaaaagaaaataggagaccgggcgcggtggctcacgcctgtaatcccagcactttgggaggctgaggcgggcggatcacgaggtcaggagatcaagaccatcctggctaacacggtgaaaccctgtctctaccaaaaatacaaaaaaaaattacctgggcgtggtggtgggtgcctgtagtcccagctactcaggaggctggggcaggagagtggcatgaacccaggaggcggagcttgcagtgagctgagattgtgccactgcactctagcctgggcgacagagcgagattccgtctcaaaaaaaaaaaaccaaaaaacaaaaaactcccaggccttgccctaacaaattcagatttcattgatctgggttgaggctggagcatccatgtcgcttttaactccccaggtggttctgaggggttcagaagcccttccctaagagttctggtccttccccaccaatggatgctcctctgtaactgctcttccacttccatcactaaagctctgacctcggctgggcgcggcagctcatgcctgtcatcccagcactttgggaggccgaggcgggtggatcacctgaggtctggggttcaagaccagcctggccaacatggtgaaatcccatctgtactaaaaatacaaaaaaaaaaaaaaaaaaaaaaaattagccgggcgtggtggcgggtgcatgtaatcccagctacttgggagaatgaagcagaagaatctcttgaaccccgggagtggaggttgcagtgaagcaagattgggccattgcactccagcctgggcaacaagagggaaactccatctcaaaaaaaaaaaaagaaaagaaaacaaagacatcatctcctcacacgtgaaaattccaagtatccagagcaagagccatccccaaatgtaatgtaaaaccatggcataattctacatgccacataaaacctgcattccacccccatcccactcaacaagccctacagacaatacaagggctgatgccctggggtatggggagaaaactgtcctagttgacattcttctaaatgctgagcatagctgactggggcatttgttcatttttgggacttgatgatcaccttaccttcccactgaatggatgatgccaaaaaaagaaagcagaaaagatatccagccttgcttgttcccctgataggtcggcagataacttctctctacttctgtgaagtaatgtgggcactggcaacattgagggtgggtaatctgacccccacccctactgtggcctatggaggggtgagacctgtggatgatcgagctttcactttgagtcagcatgtctcactttgaattccttcaccattgcttattagccatgtgaccttggccaagttatttttgtatttttgtgagtctttttttttgagacagactctgtcacccaggctggagtgtggtggcgctgtctcagctcactgcaacctccgcctcctgggttgaagcgattctaatagagacagggtttcaccatgttatccagaccggccttgaactcctgacctcaagtgatccacctgcctcggcctcccaaagtgctgggattacaggcgtgagccacggcacccagccagccactgcgcctggccttttgtgagtctttaagatggaaataacagtcatttcttacgtataacatgggctgttcccaattgcattaatatacatagacattttgttttgttttgttttgtttcgtttgtttgttttgagatggagtctcactcttgttgcccaggctggagtgcaatggcatgatctccgttcactgcaacctccacctcccaggttcaagtgattctcctgccttagcctcccgagtagctgggattacaggcatgcgccaccacacccagctaatttttatatttttagtagagacagggtttcaccatgttggccagaatggtctctaactcctcacctcaggtgatccaccggcctcggcttcccaaagtgttgggattacagatgtgagccaccgtgcctggcccttacatagaaatttttactttctgaaaataatattttaaaatgctgttgggggctgnnnnnnnnnnnnnnnnnnnntgggaggctgaggcgggccaggtggggcgaggtggatcacgaggtcaggagatcgagaccatcctggctaacacggtgaaaccccgtttcttctaaaaatacaaataattagccgggcatggtggcgggcgcctgtagtcccagctactggggaggctgaggcaggagaatggcatgaacccgggaggcagagcttgcagtgagccgagatcatgccactgcactccagcctgggcgacagagtgagacttcgtctcaaaataaataaataaataaaacaaaataaaataaaatgctgttggaggccaggcactgtggctgatgcctgtaatgctagcactttgggcagatcatcttaggtcaggagtttgagaccagcctggccaacaaggtgaaaccctgtctctactaaagataaaaaaattagccgggtgtggtggcatatgcctgtagtcccagatactcaggaggctgaggcagagaatcgcttgaacccgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggaaggcggaggttgcagtgagctgagatggtgccgctgcactccagccccgggcacagagcaagactgtgtctcaaaaaacaacaacaatacaacacacaaaaaaaagacaatacataagtgaatgaacatagctgtgttccaataaaaatttatagactctgaattttttttttttttttttttttttggagacagcgtttcattctgttgcccaggctggagtgcagtggtgtgatcttagctcacttcaacctctgcctcctgggttcaagcaattctcgtgcttcagcttcccgagtagctgggactatgggcacacatcaccatgcccagctattttttttttttttttttgagatgaaatgttctgtcgcccgggctggagtgcaatggagcgaccttggctcacttcaacctctgcctcctgggttcaagcaattctcgtgcttcagcttcccgagtagctgggactatgggcacacatcaccatgcccagctattttttttttttttttgagatgaaatgttctgtcacccaggctggagtgcaatggagcgaccttggctcactgcaacctctgcctccctggttcaagcgattctcctgcctcagcctcccgagtagctgggattacaggcacccgccaatatgcgcgtctaatttttgtatttttagtagagacggggtttcaccatgttagtcaggctggtctggcactgttaacctcaggtgatctgcgcacctcgtcctcccaaagtgctgggattacatgtgtgagccaccacgcccggcttcccagctaatttttgtactttttgtagagacagggcttttgccatgttggccaggctgatcttgaactcctggcctcaagtgatccaaccgcctcggtttcccaaagtgctaggattataggcgtgagccactgtgcccagccaactttcatattctctagattattttcaacagctgggcagggtagctcacgcctttaatctcagcactgagtctgaggcagatggatcacctgatctcaggagttcaagatcagcctgaccaatatggtgaaacccccatctctactaaaaatacaaaattagccagacgtagtggcacatgcctgtaattccagctacttgggtaggctgaggcaggagaattgtttgaacctgggaggcagaggttgtagtgagctgagattgcgccactgcattccagcctgggcaacaagagcgaaactctgtctcaaacaaacaaataaaaacataaaagcattcttagctcatggccgtataacaacaggtgttgagctggatttggcccttgggctatactttgctgaaccccactgtagtggacactgtggtagcctcctgacagcccctcctgccttcccattatgtcgcaactgtttgaatttggaaggaactgacccatccctagctccaggaggagcataactcttaacctaatcagttaattctttttttgaaatagggtctggctctgttgcccagactggagtgcaatagtccgatgatagctcactgcagattcaaccttctgggttcaagcaatcctcccgcatcagcctctacagtagctgggactccaggtgtgcaacaccatgtctggctaatttttttttttttttttttttttttttttgagacggagtctcgctctgttgccaggctggagtgcagtggcacaatctcggctcactgcaacctccgcctcccgggttcaagtgattctcctgcctcggcctccagattagctgggattacaggtgcgcgccaccacaccgggctaatgtttttgtatttttagtaaaggcggggtttccccatgttggccaggatggtctcgatctcctgacctcgtgatccgcccacctcggcctcccaaagtgttgagattacaggcgtgagccaccgcgccctgctgataatttacatttttaaaggatcattctggttctctattgaaaatagactgtagagagaggtgagggtagaagaagtgagaccattcgggaagcaacttcatttatccaggccaaaaatgatggtggtttggaccagggcagaaacaatggtaaggatgagaagtggtcagattctggatgtattttcgagcagaaccaacaagatttcctaaaggattggccatggattatgacagaaagaggagtcaagtacaactccagggtttttggccttggccactgggaagatggagttgccacttactgagacagaagtcaccgtaggaagaaacaaggttttgcgggggaggtggtgcgataggggtggggcaaggaaccaaatcacaggaaggataaaggtggggctatcttcaggctggcacaggaattcaaacgctctcagaactcatgcctcttcatcttttgtctctggttctcttccttatcagcctcattctttccttctacagacagcgatctcctggacatgaaagatggacaagctgatacccagcttgagctctcaagagaacagaaaggcgtctcacactctccacaaagctagaaacaaacaacactgtggaggatttttactggtcatacattgggtcatgtgcccttccctgagccaatctgcagtcagaaggatgaagtactctaattggccagttttgggtcacgtgcctgttcctggctgtcattgcaccaacacatcagggaatggggagttgaggagtgaggagcttcccctacacagagagacggtgggtagcccatttgtccgctaaaaccttcaagatacatctagaatgcatccatccacatcgtgctaggctgagctactatcacctggtacttggaaccgcctcctcactggtctaccgtctcccttgcaaacattttctacaacagccagtaatccctaaacatgaatcccatcacatcactctcttcctgtgctcagcttcccattctcaagggaagtcctcccatcttctaaagaatatctacctacccagcccaattatatatgagctttttaggtttttttttttagagcaaaggaatgacaggttttgtcaagctgcaggtgactataagatacagacagctgacaattgtggactcctcaggcgtggtgaaagattgagctactatcattagggttggctggctaggaccccggcaggcacctggggatagtagtgctgggaagttctggggagttgcacttctgaatgctggcatgacactgcctcaagacatctctctatccaaatggaaaaaacaaccacatcctttgtcagctaaggagagttagcaaactgtttttattaaatactgatgtctggccgggcacggtggctcacgcctgtcatgctagcactttgggaggccgaggcgggtggatcacttgaggccagtagttcaagaccagcctggccaacatggtgaaaccccatctctactaaaaatacaaaattagccgggcgtggtggcgggcgcttgtaatcccagctacccgggagactgagttaggagaatcgcgtgaacccaggaggcggaggttgcagtgagccgagatcgcgccactgcactccagcctgggtgacggagtgggactctgtctctaaatacataaataaataaataaataaataaataaataaataaataaaaatactgatgtctccaagctttggctatgtgttgcaatgtacaacctttccaatgtcgctgcaccattgcatttagaggaaatctccattccctaacaggaactacaaggccccctgcatgacgtggcccctgctgcctgttcagctccttggctcgaaatccttccccttatcttgctgattttgttttagtcccaatgtctcctgccccctcacctcagtttcttgaatacgtcaagacttctttgtctctgagaggtagctcaagttttcttctctctgcctggggggtggctgcgtctttttggttctttttagttaaaagtctcaccaaagaggtattttcctgaccccttacctaaactagtgcctgctcagttatattctcaatcataacactttatttcctgtatagcacatatcaaaatttgtgatcatttcatttgttgaatattttacctcgtggcaaaatcacacgccatcctccaaggggcgagacccctcagtgtgaaaggggcaagagacacagaacaagagtgacaaacgcataggaaagcccagaggccgctgccttgaccacagtgggtcggtctgagcagttcagtggttaggtctcttaaccaagaaagatagagcaaaccattcatgctcatgctggacttctggtttccttctttttagtcaactaggttcaaccctgatggtccaagaaggatatgccattttcatcctaagaacctctctaggaaccccaagtgggctccccacttggtatttttgctaagcaatcactgttggggggggtacaattacaggcagaaaggatctgagccccacccctcgggactcaggaatttgaggaccttggtctttaagatctgccccatcagctttcagaaagggcggggcgacgggagcagctgtcacctccttctctccaccctgccggcgttcacgtgtgttccgctgtgcagtaacagctcttcttccgggacttcctggtcgccgcgaccaatcaaaatgcttttcctgtccttaccattgtcagccgctgccaatcggctcgcctctaccaacgccccttaaaggcgcagccactgcctccggagccggggcgaaccaattcctccgttgcggcccccacctgcagtatggagtcgtctcgggggcggcccgggcccgagacggaccttctggctgtagcggaacatcaggccctagtctttggcggcgggccgggccgaacgtcctctgagccgcccgcaggcctccgggtgtccggggaggaagagaccgagaacgttgggggcgcgaaccgccaccccaggacgtccccgaagacgtcaagctgcggcgtcgtccaccggccggaacgggaggctctggagaacgagcccggccctcaagggacgctgtctggggccgggagccgcaggggggcgccgggtgcagagcacgaaccttccctgtcctcccggcacaagaacccggcgccgcccgagggcaagccctcctccgggagggactgccgtcgagggggaccaggcggcgggatggatgttgagcagcaggaggaggaagacaacgacgaggaggcggccgcgggcagcagagccggccgctcgttctccagccgtcttc

SEQ ID NO: 228 - DNA, 10000 bp, Homo Sapien
gcagaagaagccctgataaagtatgctagggcaagtctgcaggcctctgattttagctgcttaactattggatacacagacagtgttgaaagattgtgttcaaggcactgcagccctcagagaactagccccaaagcccatgaccccacaagcaactttagggagctgctgtggatgaagtacctggccccactggaaaggcactagaaaatgagctcttactttgcagggagtggtcaggggaacatcaaggaaagaagaaggaatcatcaatggggcttggggctcactcaggaggagctcttcctgataggtgctttaaaggaatcagtgctcaaaacccctggatgtgatgagctcattcatccttgagggaccctttgtcgcctctcacctgtccttctgaggtcctccacgcgttccccttctctgttcttattccaaattcctctactacatttactcaccctggatttctgggtaaactttattagatttgttacatctattttcctttcccattagtcaatttttaaatgtggtagccaaaataatcaacatcactagtaattatacccatactcaaaaactcttctggtgaagaggcatggcagaactccacagggaaatcctattgtgaggattatataggtcggaaagtcatttttaactgacatgcatgataaagcacatgctacataccaatggaatttaacgttcaaatggaataataaactatgtttgcagtatacatttctagatccatacatgaaatcacatttccattaaacagttttcaagtcagtgaccaattccctcctacttctcctgaaatttatatgaacctggatcattttaataccactggaaagaaacactatacttagaaggagatgaacaacagatttaatattttttcgtttgcggtactaggaggcaagctggtaactctaatgccctgtgtgcctcgactcctagatctgagtagtcaataagaaagtagggaagggactaccagcaagaaaagaagcccactaatatttccttctccttccttctgtgttttcttctgcttaataattgagtctaatattaatggacaaggattgccagaaaaggcatgatctagaacaggggtcagtaaccttttctgtaaaggaccagagagtaaatatctgagcccttcgcaggccacatgggctctgttacaactactcaactgtgccattgtgccacaaaaatggacacagcattgctgtattccaataaaactttaattatgagccttgaaatttgaatttcacatgattttcacatcacaaatattaaattccaatcatttaaaactataaaaattattcttagctcactgatcctataaaaacaagcagtgggccagattcagcctataggctatagttgccagtccctggtctaaaacttttaatacattaagagtattcttctcattaaaaccactgaaattgaagtcattttctctctttctgcccatttacttttccctaagactttaatttttttccccacactctcattcccattctgatttaccaggacattacttctcctctctacctcacatatttgttttattgcactataaacctcactggagaataaaactatttgccaaagacccacctgtaaacacccagcactgcagcagccactaacaaagaggaagacacagaacctgtggccaatcatgtggacattggcaataatccattcccttctccttctttcttcctggtagagtccacctcttataatagtctgaagaaaacagattgttacttttccaccttcctggcaaacaaaggggtatgtctgtgaccaactcctggacagtaagacctgaagagaagtctgttggggtgcttctaggaaaggtttttctcactggaaaaaagaaagctacaagagcagaatccccaccctctccttgtttcctacttttagatgatatcatgtaaagagacagtgtttagagctgcagcagccattttgcaaccatgagggaaatccaggaattggtccacaggcataacatcattaattcaccaaagcacctccacagctctctccccctggacttcctgttgtaggcaataataaatccccaagatgggaattttgttgccatttattacaccgacagacttcattcttgcaaagcttacattgctagaggagtgatgtgacacataaaatgaaaaacccgttacaaaaaaacataaaatatcaggcaggacacagcggctcacacctgtaatcccagcagtttgggaggcggaggcaggtggactgctcgagcccaggagttcaagaccagcctaggcaatatggcaaaatcccatttcgacaaaaaaaaatacaaaaattggccaggcatgtagtggacacatgtaatcccagctacttgggaggctgagatggatcacttgaggccaggaggttgaggctgcagtgagccgaggtcgtgccactgcactccagcctgggtgacagagtgagaccctgtctccaaaaaaaaaaaaaaaaaaaaaaggaagaaaaaacctaaaataccataactcctccctccttggcagctctattcgacctaaatcaaaatacgttcatatctctcccacagagttactgctctatatatactttctgctttacagacaaacttcttaaaagttaatctgtccttagcagggcacagtagtgcacacctgcaatcccagctacacaggagactgaggcaggagtatcttttgaacccaggagtttcagaccagcctgggcaacacagcaagacatccccaccccaccccacctccgccactgtctctaaaaacccaccaacttatctacccttaccatctccacttcctattctgtcatcctcactcctcaaatagcaatactctgcccttctttcacccacattactccatcaaactgctttcaacagagtcaccagtgacttcccagttgataaacccaagcacagtttttagctcttatctggcctgacctctccacacaggtcaaaatagtcgatactatacactatacctcccccgcaccatactttttttttttggtttgtttgttttgagacagagtcttgatatgtcgcccaggatggaatgcagtggtgtgatctcggctcactgcaacctccacctcccgagttcaagcgattctcctgcctcagcctcccaagtagctgggattacagacgcccaccaccatgcccagctaatttttgtatttttaatagagatggggtttcaccatgttggccaggctggtctcaaactcctgacctcaagtgatccacccatctcggcctcccaaagtgctgggattacaggcgtgagctaccatgcccggcccacaaaaccatactttccagattttcttttgcatccttaagtatttatttctggcttctccttctactaggctcttaatactagtgttccccagtgttcctgtacccccctccctgttttttcttattttacccactctttttatatagtctcatctgtacctacagctttagtgaactaattagaagtaatttgtaattagcagcactgattttcctgttgaaagttaactactaaaatccctcgatgtgacagttcttttagttaggacaaacatgcccccaggaaatgaagtaatactattcatttgcttgcaaaccattttttccccatagatgaacttcagcccaaataaaatcaaactatccaaaattcccagctacttgggaggctgaggcaggatccaaattcatgtaattttcgtgtattttgcaagtttgttttatgccatattaattcattacactccacatcatattttcttagcaaatacatctagacacctggcactcagtaagggatattcctggcacgataatcattgttatcattagacattgcaggaaccaccatatggatggataaatgtgttgtttaatgaaggcaagcaattactttaagagatcctagttgttataaactctctctggacttcaagtttggtatatacataattattaaatgtatacataattattaattgtaacatgtcctcacaattgatttctggctatttttctaaggattttacactttatttagtaaaatatattaaagaggttaatgataatttttttatagagacccttagattgaaaatgactgatttttcacacctcttttcttgctttactaatcgtcagtgcctaattgctaaagcaaaatatcttctaaattctggggaggaaattctactttgggccaggcgcggtggctcacgcctgtaatcccagcacttagggaggccgaggcgggctgatcgtgaggtcaggagatcgagaccatcctggctaacatggtgaaaccccgtctctactaaaaatacaaaaaaaaaaaaaaaattagccgggcatggtggtgggcacctttagtcccagctactcgggaggctgagataggagaatggcgtgaacccgggaggcggaggttgcagtaagccgagatcgcgctgctgcactccagcctgggcgacagcgagactccatctcaaaaaaaaataataggaaattctactttgaattgcacactaatcaaaagactccagcttcatttacagagaccttatctgtgctaagtagtttttggaatagcttttttcctgtcacttaagcaccttcctttattattaatagtaaactaaataggagtccaaagtctgcctttcccagtgctagagtataaatgtcatcacacggtagaatgtaaacatcttttttttttattatttttatttttttggacagggtcttgctccgtggcccaggctggaatgcagtggcatgatcatggctttcactgcagtctcaacctcctgggcccaagcaattctgtcaccccagcctcccaagttcctggggccacaggtgggcaccaccatggctaactaattttttaatttttttttttgagacagagtctcacactgttgcctgggctggagtgcagtggtgcaatctcggctcactgcaacctccacctcccgggttcaagcgattctcctgcctcagcctcctgagtagctaggattacaggtgcccaccaccatgcctggctaattgtttgtatttttagtagagacggggtttcaccatgttggccaggctggtctcgaactcctgaccttgtgatccaccggcctcggcctcccaaagtgctgagattataggtgtgagctactgcgcctggcctgattttttaatttttatttttatagagatgaggtctcactatgttgcccaggttggtctccagctcctggctcaagtgattctcccaccttggcatcctaagtgctgagattataggcatgagcctccatgcctggcccctttatccatcttttaatgttaataattatatccatttctgtttccttcaaaaattcaagtggaaaacctgacataaataatggtaacttttttattatacctatatcaattaacacatatgtataaaacttctacttagttgtgccaaatatcagtgcacagtatgggtgatttcccccacttgcgaagaatggtgctatagtcaccgcacaggagcaggatagatccccactctcaaaattgggtttggatatcaaaatcaataatgccatcacacatgcagcaaaggggtttgaaaggtttattgctcacataatacgtttttttgggggagagtaagatgggcttccaagctggtctgaaaactagagagaacaagaaaggagaatggctttgggattcttattgtggttaggagtggggctgtggtgagggttcctgtacatgggctagggcttactgttggaactttgtgctagtgccaaggaaggagcacctaggcattcttatcagtttgctcagatgtggggcagagaggaagggaagtggtggggcttgagaactgtctgcagtcaaacatcaaaaattaagtcatactctgtattacaacaattagaaaagaaataaaatgtagtatatcagttctctattgctacaatattgttacataacaaacaacccccaaacctcaatggtatacaaaaataaatgtgtcctgctcacacatctggagtcaactaaacagctctgctgatcttgcctgaactcattcatctgtcagcttgatcttggctggctttgccaggggtgggctataccctgctctatgtctctcatcctccagtaggccagcacaggcatgctatcatggcaaaggcaaaggtgcaggagtaaaccagcccaataacacaagcactttttaagcctctgcttgtggcacttttgccaaaatcctgttggccaagcatgttacgtggccaagccatgagatgtgtacacagaaaaataaaagatgtgtacacagaagagcaaagaattggggccatttttgtaacctactgcacctattaatggattactaatatgtcacaactcttatcctagattacagtattaagagaaggaaagtcaattcaatgatatatttactactaaatgttaggtactgtacttggaattagagttacaaaactaaatgagataatcctaaggagctcacagttggatactggaaaaaaaatcaaacaaattaatacattattaaaataaatgaaataaaatccaatgtaagtacatgaatagatattttaataagaagtggcatggaaatgaaaataaactcttttgtctcctttatcatatatttcatagctaattaaattaattttattataatcaaatttactgtagacctgaggacataaagtttactgagactccctagcgaatggctgcataaaaatgcaagccctctaaaagcaaaaccagattgtaaattctgttaggctaacagaaagtcatttgattcttttgtttttccgttacacttagtagtcaaccaaaatttattgtgtgcctatatgtgtgtattagtcagagttctctagagggacagaactaacaggatagataggaaggggagtttattaaggagtattgacgcacgatcacaagatgaagtcccacaataggccgtctgcaagctgaggagcaaggaagccagactgagtcccaacacctcaagtagggaagctgacagtgcaacctttagtctgtggctgaaggcccaacagcccctggcaaatcactaatgtaggtccaagagtccaaaagctgaagaacttggagtctaatgtttgcgggcaggaagcatccagcacagaaaaagatcaaggccagaagacgcagcaagtctgctcttccgtcttctcctgcctgctttattctagccatgctggcagctgattagatggtgcctacccagattgagggtgggtccgcctttcccagtccactgactcaggtgttaatctcctttggcagcaccctcacagacacacacaggagccatactttacatccttcaatccagtcaagttgacactcaacattaaccatcatgatgtgcaagctattttgctgggaatttgctaggatcgaaaattcctagtttttttgttgtttgtttgttttggttttgaatctttaatgagaaaaaatactattgtgctcaagaacaccgtgcgtctggtgtgtcattgggtcaagggttggggacacacatggcagaattcagaaacagggtaacatcaacaaaaatacacacggtcataaaaagaaaaactggcacctggcatgatcaactctgtttcctcatcattcagcagcatgttggggatcctgcggctgatggggaacacacgtccagactctgggcactgcagggtgccctccaacacatctacctccagcagcacgtggtgcattgtcctcaccatggagattcctagcaaatactctaggtattttaaatagaagaaatttaatacagggaaatgattacatatatagtagaagaactgagatgtcaaacagaagagtgaggcaatccacattttagcaactgcagtaagtgacctccaatgtcatggctggagggtgcaaatggtgagaaggcagaagctagaatcatggtggaccccacctgcaagagtcacaaagaagatgcatccattcaggtcacagagaagtaaatactctagtgtctaccttctaccttcttattgctctctagtctcccattttatctagactgctgacaagcatgcagtggaaggtgagcaccagatctgagaggaaacaggcagtgtctggtggcacactacacaagaactctcacaggcatccactaggcttgcttggtgactcatttaaggagtaaccctattttatgtatcagagtagtctatggtgtgatatagcatattgctgcttttgatgtttggtttcatttgttccctgtaggcacctaatcactgttttttaaattccccaggagattctggtatacccaatcagctgagaaccactgaatagtggctttcaaaattttgagcatccaaatattgtcttcacagaaaatcttaatctctgaagtctactgtaaaaacatagaaaggcaaggctgttctgcttgaagcgtagcttgggagcctagattcctctcaaacccaggccactcctgggaacatggtctggagatttgaatgttcccaaatctagtttatctcattagtcgatatttatgcacatcctctgtgtctctcagtgttctctcatgtgtagacatatgccccattccaaagagtgactgtagtgtaatgtggcattaaaggaaccctggatagacctgtattggaccttacatattagagagctctgcagatagctcacaaatctccaagtcgctagctgtaaattgagtgataattggtgtcaggttattttagcacagtttggggataaaatggtgcattaatctcccagtttgtggcttattaaactttgaaatggaattatttgagacataaaagagatagcaatactttgctggatgttctccattagtcgagattgttacagaggagaaatttttgccactgtttatcaaatattttttcctctagttaatccatatcattccgggagctttgcccaggaaaaggacgaattacttgcgttcctccgatctctttcaagttctactcccgtacctttaaactgtcacacggaatctttggtgacagaggaatagaggtgggcaagcagggcgtttggaaaccatactgaaaacgaattatccataaagcacagattcaccagcctagaaatggctctgtctggatggattccttgagatgtgttttatttccattaaaaacacaacaactttcaaactttcactgtgtctcaaaatgatagagaaaaaaattcagcctttcaagtattcaagaaaagcttgaagaaataaaagaaactcgctgctctctgggccactttaggaggcagagcgttcctggagaacttcaggattcattcgcaagggaacccaaggtgggcattcaaagccgatccaaaggatattcttctttttagaaaacaaaaggagcgcaaggagtaggggactgaaggtgcccaaagctagtgggtcagtgtcactttcttcctccctttcgcccctttcctcccgctcctttctcccctgtggtctctgctcagcacccctttctctccagccccgactgcccatcttcgcccctaccctcgcgcgtcggggccgtgtctacacccaccccaggacctggtccgtccaggctccttcccatcctcacacccgcgcctttctccctgcggccccggctcgctgctccagctgcccagctcttcccaggacaggggatcccgccaagggggccgcccccgccccggccctcccccgcccggccgcaccataaagcgcccggccgctgccgcggagcc

SEQ ID NO: 229 - DNA, 10000 bp, Homo Sapien
ccaatgtaagaatccagcagtgatgcaatctgcagcagcaggggcagctggcatctcccttctacaaaaaagagtggcaacaaaagagaagagggatgacttgatcttggcttccaatcttgtgatcatgtgaacagtagggttgggttgaaggtcatagtgagccatccaagagaaaccatcatgtaaacagttggggagcagtaaatacattcaaaccaaattgggatataatgcaactggaagttgacttctggatccccagaattatggctagctagctgcacaagttctcctcattatagccataatctcttagtcctgtgattgaatattttggacccaacttagaggatcactctccttccacaagctcctgtaggagaggtccaaccagactgtacaagtaaaataatgctaactagtagttttagtgacctaaaggaaatactgaaattgtcaaagagcttaatgaccagatatcttggaagaatatggcacagttatgtatttattactgtatgcaggtaacatgaccttttgcttatttcatatgaaaaaaacattcagaccagcacatatgtatgcctacatatgtcaccaattctaaatctaggcagtctcaaattttagtgcacagtaatctagggtttttatttaaaatgcagattcactggatctggcagagccctacaattttgcatttttaagctccccccgccccaaagatgatcacatttcagaaaaacattctgaaaaaaatactacctgagctcccaggtgttagtcaagctctctcgaccagtgcggtggcccatttcatgtgttcaataagtgtgcattgtattgaataagtgtgttctccgccctaacagcattaaggcacctattacagcttcttgaatacccatatgtatcaagtctgcctttaaaaagatgtaatttgagttatcaccgaagataatatggcaagttgctaaatacatgaaattcacttgaagtcagccaagtctggggtttatctttatgttcttgacaagtcattagcctagccccaaccgaataaagtcttcttcattttttcatctaccacactatgtcttcaaggacaaagaggggcagttaaagatggagaagaaaaattccttatccaataaaatcaaatgcaaatatgaactgtactggattcattttttcattgactacaaacgggatttctagactgtgggctcctccctatttgattctaggccttaaatactgagctaaattctgaagataattttagaatcctcactcatcctttaattctatcgtaacatatttattgatttactaattgagaccattaatttttaggatgaaaccctggcattttaaattaaatggtatgtcaattattgtgtgactttctatacattttctaagccagaaatagtcaaaggtgccaaaacacacaccactacggaatttgaaggaatttcgtatgaaagctttgccctaaagtttgtaaatatgaactaagaaagcatacaatccacaaatgacttcttgtgtttcttcctggacttcaaagtacattttcttttaaaggcatctaattaactctttacttactcatgttcacgttccttctacctaaagcattttaatcagagacagtagtttgtatgtctctaaatacattttaaaacctccaaaaactgattatttagatcattttatacaaaattttatcaagacaagtttagtctgcagagttacttgtataagaacaatgttagatccctattttaggctgggtgtggtggctcacgcctgtaatcccagcactttgggaggctgaggtgggaggatcgcttgagcaagaccagcctgggcaacatagtgagacctggccactaaaataaaaaataaaagaacaatgttagattgctattttagatgtgtaactaatgctccagcattgtctcccactactacctagtaactttctgaatattgagcaaagtatatacacactaggggatggaaattaatctaaattgtgtgtcttataatgttgcaacatcatgcctgtttatgagcttaaaaccttcttaggcatctccatctgagtagctactttaaatttttagcagaatccagttgcccatcaattattaaagtgcagttcatgaaaatacaagggtgcttagatagatatatattccagacgtaaaaaaatcttatggttgctaaagaaatataatactttaagagattttaaagtaattatttcctgaatgtcttttttcccaaacattagaccaagttgcattgtttacaaaaatttattcatacaaattttacacactttatataacagttatcaaagtcctagttatagatatcatgtgtgtaataatacttggttaaggtgtttttataatcagttgcacacaaaataagagcttcaagactaacatctacctaaattatcactatatcataaatctgcttcagtttagtaaggctcttggcatttctaaaaagtatacaaaagattaaactgggtgatcactgtaaaatgcttgcaactagccacgggaacactaaattagacttcataaataaaaggttaactagagccctatttcaccactaacagctgatacaaatacagaaaactctgcccattatccaagaaacaaataattaagactaaaatgcaagctgatgtgttgcagcattgtagggccactaaatagccatctgtgattcgtggcaatttaaaaggcgaagaaaggcactaaagctgcaaactgcatcccgtgtcacattgcctgaggagactgcggaattaaaggaagattgatcctatacacaggactcaggcatagaccgaatgcctctgttttcactatttgcaatgtgatctcctggcagcatccatcccgcctgggaatgcaaatccaattctgttttctttgatttatgacttcatactgatcaaatccgtaaaggaaaaggaaaggtcctttaaactttacaagctaacgtttaatctttccttgttcttttttttttcttcttcttcatcttcttttttcaaaacataaaaaaaaaaaaaataaacttgtgcctgaaatttgggagattggctggctggtttgtctgttgctgctcgatctgattgctgggtgaaggttcttttgtttataaagattactctgtatgttcaaagaattgacaggaaacagacatgctttctttagccaaagaaaggatacaagcgtaggttctcagggtctgttggagcttgcttacctcactcttgaccacagatataagatagtactcatacatatgaagaagaggattaaatgatttatcagttagcaaaactgagcaacatgtgaacactacacattctaatatgacaaaggttggttttatgaaataaattttactaagcaataagcaataatgtagaaaaatacattttacctacaaactcaataaacaagaaacaaagggttcatatttagtgcataattacttactagtggctacagaggggtttctaaaatttacaataagtgcctgcatcaaacaaaaaaaaaaagtgagaagcattcacaagtttaagagaagtgaatgaaaaatggtaaacagtacttaaacagtgcaggagggtaggaaggagaggtctccataaaaccacaaaggaaaagggtagctcctacagagcaggtttcaaaggagaggatcctggccatttcacaagatgagaagcatggacagcactggagaaaaacacattgtactttgcatccatttccaatacccagcgcccaaagtcaggaccattgggactggatttgccctcagcttcccagacctggggcaatctcaaaccagtccatttccagggtcctcctcctaccacctcaggctctgcctcttccaatatacctctatgtccttcactttgttccaattgccctaatttggggatattagattccctggccactcaggaagtacagaaaagagagcggtctaacgaagccgcccttttctgtacagttcctcaactcttctcctagggagaggcgtgaattctggggagaagcacaatttggatcgagctgttgttttatcaggagaattttcttctgggctgagagtctgaagagagacaactacacataaaaggagaatcaaagaaagcagaaatattggaattgccacccaaccagggggacagagcccagttgagttaggctgggattgaagcagcctgccccagagactcactgggaaagaatgcccttcagcaattctccatatctttacctcaaaatctccctggagcagggcatcattgtttatgtacagtagcaaatggtaagtagtaatatcttcaggcctgtcatggataaaaatactatccttttaattccagtttacaaaaataggagtaatattcaaaacaatgattgtctacttttctatttatttttataaaaacataaacagctcgggcgaattttcaatccttgtgcacgctttgtatgaacttctctctatactttatatatatatatatatatatatatatatattctttatatatatttataatatatatcaataattggtccacaaagtatatctgtgcattctctagtgctttgtagaaagaaaaacaatattattatcaaaatattcatttaatggctttacttcattacataaatacatgtttggatagaacacacgagcgatgactgttgagtcagtttggaaaacgacttttcattgcgtcagggctgtatacacagggtagctggtaacccatcgctacaaataagctattcggcgtcctttgtttttaaccctttgtttatacctcttccctaggacggccgccaagtatttcttgacagccatttgtttccggtagcggctgtagctgtccgtgaagatcccgtccgagtggcgcttggagagcggctccgcgtcgtcccccgcgccgccgccgaggctcccactgcaagcaaaggggtcgggaagagggtggcggggcgggagacacaggttcaatcgccgcggggagcaggcgggccccaccccacgcgggagccttcggggagggcccggggctcgcactgcccaccgcgtcgcccgcctctgcctggaagcagccgtggggagggccgagacggcagcccctcgatgcccccctccccacgcaggatctcctggcaccaaaccctgcggagggggcccgggataagatccgggcaggcgacgcgcgcttcaagcctaacctttctcccagcgctgcccccttgagatccgacccttcgtgtgtttgcgctaaattgtcctcgctgttcctctcacccgcgacatacagagaaagtaaccggagagccctacatatgccagtctggctgctgccctggagtttgcatcgatcctgcaattcctagtcaaatatgaacactcctctccctcctcacgccgagttgaaaaacgtgataataatataagtcgacaggctgtaggcaatatttttcactgcatgacttattcatggcgaaaatgtaatctgttttcccacgggctttattagaatgttgccttctgccgagataggcttcacgcaagccctgtgctctcggtttctctggcgtgagcaaaactgtttgggtccgtaagtgtccaaatttggccatttattatttcgatttgaattttcagtaaatacaaccacccctttcccctcccccagaaacagtcatgcttagagaaaattatagcaaaacctccctggaagcctgaaggttttggatgactgagaggtttggtttggtttctctttcttttcattcaaaacggatcaaactccctggctcgcgttccctttttgcctcttccagagctctctgggcaaatgtaaagtgccacttcaaaatctccaactgcgacccgtggcggatgcccaccccagacccaggggcgcagactcaccctggcccccacgggcacccaccgccgcccgccccgcgcgccccgcacaggcacccaccccggcgcgcgcaggttaatccttccacaaactcttaccccacgccccgggccacgagcgactgcaggtgcttcccggcggacagctggtccagcactttgcggtaggcctcgttaaggatcccgtgggcgacatctctaacggggaggcaaagtgcgcgcccagggtcactgtttctgtccccaggtggccgctagagacccccttgttgggcgcgcgccccctcggcggccggggaggctgacagggaaacctccagaggcccagaactcgccaataactcccgggatgatctcgagagcaactgctaggatcgggagctagtcccggctctaggagtggcagatgcggagtgtgggttccttgacgccactcactgccactctttgggccacagcccccctcggtccccacgcggccctcaggtccacacagacccgcccgctgctgattttctgtcgctgcaataggatcgggccagggagaggacaggcttgaggactttcacgggaaaaaaaaaaaatcctgggtgggtcaccacactgcccctcccgtcaccgcagtcccgagctcccagccgcgggtgtgcgcgaggccgcgcgaatctcaccttctcccggccgggcggtaccaggcggcggcggcgcgcggcgcggaggcggggctccctgcgcccggcggctccgagccatcgaagtctggcagcgggtttccgtcctcgccgtacgcctcttcctctggcctgcggggtggccggggacagaaggtgtggtcagtgcaagttcctccccagctcggcgaggatccaaagtaaggggctcgcgcggattttcacggttgataaaagtcctccgctgagaattgtctcttctcccaggactgggggtgggagcagaggtaaggaggaggcaacgacacccaaccactcctaccccgccgggcggcccgcccacccccccttcgcgggtaaagggtcgtcctgcgggccacggcctcaacaagcgctgggaaaccgaggcgtctccgccgatcgcgcacacctgtctacggaaaaggaccgcccccctccccgcctggctcccgagcctccccaaagcagcaacgggcggggacgagaaaggccctgggagaccgggcgctgacccacgcgaagacccgaatggggaggcccagaaagcaaaggagaggatgcgtggggcgtgcgggggccaactcctcagccacccccaccccagcctccgagcccaggggagcccttccccgagcagatgtaggtcacggagaacctcggtttctattttgggcaggcgaggatctggcaggaacatgaataataaatgcccctaaacttagccagttcggcggcggctcagactgtggcgcgtccgcaccctccggtgcttctcgcacggagaaagtgccaggcacacgggaacttgaaaatagctgagggtgaaaccagggtgttttaaggccactaaacgaatagttcgcgctgatctgttatcgatggcggtgccccatctcaaccccagagcacgaggagggggaccgagatccagcgagtgcctggcgacttcgcagtcgccctctacagcctccgttcttgacacaggacgggtagagatgggttaaaacaaatccctctcgctttggacccctggagagacttggcgtgcagccagcgctagtagcactctctgggcggggttggagtcgtacttcgctacttcactcgccttttctccatccttggagaggcccgggcaaggcaagcgcatcattccgcacgcctcgcacccagcctttgctcggcgatgcgcctcagccctggcccgggtaccccgaaccctggggtctttctggatattgccctgcctcgagcccagatgctggaatcctaatacagaacccagaacccatctctccgtccaaatcaatgatcagcggccccccagagctaatgttcctgggcggggctcggagaaggcagcttcgcaggcagaacgcgcgctcctcgctgccccaggcgccgctggtacgaaccctcccctacccagggctcatccacagcctggcacatcggcccgcgactctggggctgcctccgggaacctgggccgcgcctgccggttagaaacccggggttaagaaaaaagccaaggttcctccatcccgggccaggcagggctgctctcccggtcctgcctgcctgctggctttcccttcctcctcctttgcgcctgtttttccccctccttcgcagtctcgtccttgttcttccctctcttaagtcgcttttcctcaatcacaccgggccaacaccctccccaccgcacgccccccaagacagcctgggattcaaaatgcagttggaacacggatcacttgaaagaaagctcttcaggggaaagaattggaatgaaatgaaaagaaagggtggaggagagagagagaccccacccggatagtccagaacaagcagtaacaaagcaaagtccgagggagcttcacgctcaacccccggccaggctccagagctgaagttctcctaactcgtcccaagaataggtaaaagaaaccaagctaggggccgtgccctgcccccatcctgtgggccgggttgggggagggggggttctccagcggccagaagctcactggctctacccgggaccctgagctgcctagggctgggggaggcgtccgagcagtcgcggagcctgccagaccctcggctagaatggggacccgctgtccagccgaggctggcggaggcgcaccgggggcgcagagggcgatgctagtagtctggacccaaaggactgcaggaaggagaccgtgaggaagcgtctgtgcctggggagccccagctcctgcttgggccaggcagccagcacctacctgatcccggggaaccggagtccggcggcggcaggtgagctgtagacgctgctgtgcatgattatcccatagaccagcagggccagcctcgctccgctacacatggtcattctgcgcaggatgggaaagaggacacacagctgtgagaacgcccctggcctcccaccctccaaccccaaaaagctctggaagccgggggagggacggagcgaagccccggctccctgagttgaacagcacttggcgacagccggtgcgcgccctgccacttcttgcttgctatagttagaaaaaaatatatatatatgcatctacccggcgcccaataactagccagacccggctgaaggaaagctaactcccctgacgcgacgccaagcgaaagaatcagcagtcgagtgagccggtcgctttggtaagattttccctcccttacccttcaactcctcccgctgccaggagagctgccaggtaggacggcgggcaaagcgcttcttcaagttcctgcgctggagtcaccacccgagaggcatcgccgtctggcgttggtgtctgagcagaagccgcaggaaccagcgggagcagcaggaggagctgcgggactcgtttgccgaggctcgtgttctgctcaaaagtttgtagacgcgcagaaccaggagggagcgtgacacggagagaagggggcgcagagagagaggcagaagaaagaaagagggggcgatgaggtgaagcgcggaggagcaaggtggccgtaagtccacccggaggaagaagcaggcgattaagggaaagagggaaagtcagaaaagaaggggaggaaggcaagggagagggcgggcggctagcccgcctttgtaggagccgcgggccaggcagccgcgagggtcggcggcgccttctctgctccgaggtctctccggctgcctctgaagctgcggcttctgctgctgctaccgctggttacagaggtgaccggccttctgctcctatttatctgtgcagttcgcaaaaatc

SEQ ID NO: 230 - DNA, 10000 bp, Homo Sapien
gataaacacacaacactagtgggagaattcaacaccccacagacagcattagacagatgatcaagacagaaaactgacaaaggtactcagaatctgaactaaacacttgaccaaatgaacctaatagaccaccacagaacagttcaccccaaaagaacagaacacacattcttctcatctgtacatggcatgtaatctaaaatgaaccacacaatctaacataaaacaattcctagcaaatacaaaacaacaaaaaatataccagtcacgttcttggaccacagccctataaaaatgtaagtaaatactaagacaatagcttaaaaccatataattacatggaaattaaacaaccctctcctgaatgaattttgggtacatatgaaattaaggcagaaaccaagaaattctttgaaactaatgagaaaaaagatacaacataccagaatttctgggatatagctaaggcagtgttaagaggaaagtttgtagcactaaatgcccacattgaaaagttagaaagatctcaaattaacaacctaacatcccaacaaaaagacctagacaaccatgagcaaaccaatgccaaagctaacagaagacaaggaataaccaacatcagagctgaagtgaaggaaattgcaatgcataaaatcatacaaaagatcagtgggctgaggagttttttttttttaaattaagatagatagaacactagccacaatgataaagaaaaaagagagaatatacaaatgaacactttcagaaatgacaaaggggacattaccactgaccccactgaaatgcaaacaaccttcacaaactactatcaacacctctatgcatacaagctagaaaacctagaagaaatgcataaattcccgggcatatacaacctccaagactgaactaagaagaaattgcatccctaaataaaccgatgatgagttccaaaattgaatcagtaataagaagcctgccaaccaaaaaaagcccaggaccagacagattcacagctgaattctatcaaatgtataacaaagcactggtatgatttatacagaacctattctaagaaactgaggaaaagggactcctccataactcattctataaagccagcagcaccctaatacctaaacttttcagagacacaacaaaaaatagaaaacttcagaccaatatccttaataaacacagatgaaaaagtactcaaaaaatactagcaaactgaatccagcagcacatcaaaaagctaatccaccataatcaagtaggctttatcactaacatacaaggttgtttcagcatatgcagatcaataagtgtgcttcatcacataagcagaactaattaacgaaaatcgcattatcatctcgatagatgcagaaaaggctttcaataaattcaacatctcttcatattaaaaactctcaacaaactaggaattgaaggtatatacttcacaataataagcaccacctatgacaaacaaagccacatcataccgaatgagcaaaactggaagtattcccctggaagataggaacaagacaaggatatcttccctcaccactcttaatcaattactggaagtcctggccaaagcaatcaggcaacagaaagaaataaaagtcatctaagtaggaagagaagaagtcaaactatccctgtttgcagacaatgtaatcctatacctagaaatcccaacagtatttgcccaaaatctccttgatcttacaaacaaactcagcaaattctcaggatacaaaaatcaatgtacaaaaattagtaacattcctatatatcaacaacatccaaacagagacaaataaagaaagcaatccctttcacaatagcagcaaaggaatacaacatatagaggaatacagctgaccagggaggtgaaatatcgctacaaagagtattacaaaacattgctcacagaaatcaaatatgacacagacaagtggaaaaagattccgagctcatggatagaaagaatcaatactgctaaaatgcccatgctgcctaaagcaatttacagattcagtgctatttctgacaaactaccagtgacattcttcaccaaagtagaaaaaaactattttaaagttcatatggaataaaaaaaaaaaaaaaagaaagagcccaaatagccatggcaatcccaaggaaaaagaacaagctggaggcacattacctaactttgaaccacactgcaaggcaacagtaaccaaagcagcatggcaatggtacaaaaacaggcacatagaccaaggaaatggaatagagagcccagaaataatgccacccacctacagccatctgatcttcaacaaagttaagaaaaacaagcaatggggacagaccccctattcaacaaataatgctgagataactggctagtcacatgcagaagattcaaactggatactttcctaatacatatacaaaaatcaaagcaagctggattaaatactaaaatgtaaaacctaaaactgtaaaaagaaaaataacacctgaaaaataacctaggaaatacctttctggacataggacctggcaaagagttcatgacaaagatgccaaaagcaattgcaacaaaaacagaaattgataaatgaaacttaattaaactaaagagtttctgcacaagaaaataaattatcaacagagtaaacagacaacctgcagaatgggagaaaatattttgctaactatgcatctgacaaagtcctattcagaatctataaggaacttgattttgcgagcaaaaaacaaacacctccatttaaaaatgaataaaaggcatagacaattttcaagtgaagacatacacacagccaacaagcatatgaaaaaatgctcaatatgaatgaatcattaaagaaatgcaaatcaaaaccacaatgagataacctctcacacccctcagaatgcctattacaaaacaaacaaacaaacaaacaaacaaaaacagactctgtcaaggttgtgatgaaagggaatgcttttatactgctggtgggaatgtaaaacagaaacagcaaagcaagtaccacatgttctcacttacaagtgggagctaaacattaaatacatatggacacaaagaagggagctacagacaccagggcccacttgaagacggagggcaggaggggggtgaggatcaaaaagttacctatcaggtactctgcttatcaccccagtgatgaaataatctatacagcaagttcccatgccatgcaatttacttatataacaaacctgcacatatacctctgaacctaaaataaaatctaaaaaaaatttaaaactgcagagagaagtgagatttctctttaaataaggcaggattgatttagtgatttagtgatatttgaggagtggtagtgtttagtgttgatatctgagaaagagcattccaagaagaaaggacacaagtatgaagtccctgaggcaatgcttggcatattcaagaagtgacacaaaggccaatgttgctagcatgggatgagccaggtgtgttttaggacagacaggcagacaaaaacagatcattcaaatgattataggacttcgtaaggattttggccttactctgaatgagttgagaagccactgaaaaatctggagcagaagaacagcatgatcaaatttgcacttttgcaggctctctctggctgctacattgagaatacatcaggggaatgtgcagaactagaaaaaattattaggagttgatagcaattatcttggcaagaaatgcagaaatttagatgagtatggcagaagtgacgacaagggattggattctgtatgtttttgaagacagagtctataaaatttgctgagatgagatgtgaaggagagaaaacgtggactctatgttttttgtctaaatatctgaaagtctgaagtcttcattaacaaaaggaaagactgtaggagaaacagatttggggatggaaggaaagatgagtaatttggtttagacaacttagttctaagttcttgtcagacatccaaatgaagatgtcaaatatgctattagagaaaggattctggagaccagggttgggttctgagctgaaggattaaatgttcacatcatcagcacacagaaagtaaggccatgaccagatgaacttacctaaaaagtaagagccaaaagagaaagaaaaaacataaatttagacccttattttataccacacacaaaaattaactcataattcattgatcatggagcaaaaacttaagaactatgattactgcgatactgagacactaactgtaccaaatgcaagaaataaaaaatgggttaatcaatcataattctatctatgtatttctttacttagatcattatgtccataatgattatcccctgcctatcaatctatcaatatttacattgctattttaaataaaactaaattagatactgagtcactatcactctgaataggcagaaactcaagtgaaaacattattgatcctcccacattctccctagatttttggtcatgttacttttaaatgtaactgacatttgaagaaaaaagctttatataatgagaaatatgtaaatagatgtacataaataaataatatatataaatacatatgaataatcagccttattcctctctattgaaccatttggctacattatcagtaaggagactccatgagatcaccaacaaaacaagcccgattgattaaaggttgaagaactgagaccttgggcagtgtgatattttcaatttagagacaagagagaactagcaaaggagactgagaagtggtgcccagtaaataaggaaaaaatcaggagagggcagcatcctggaatgcaaataaactatattcagtactgctcacagagcatgcaacatgaagaccgaccattggcaacacagactccctggtgatcttccaaatgtcagattcaatgaagtggtgacaacagccttattgaaatgggttgataggccaatagttgaagaggcttcatactttgctaaataattataaaccaagagggggaaagagttgaaaaagctgattcctgaggtcagcctttaacattgaaaatggaaaaccctcagccagttctcagggctgagccaattcagagaagcagaattcaatgattgaagggaatcttaagtcctcttgatgatggacattgaaaatgcactgcaagaacactcaggatgtatcatatgttgctttctcaaagacctgtagctattccccagaaaacagtcctcagagaacagaacacacgtccatattatctgagacttttaagtttggagcctgaactaacactaatatctgggtaccccaaaagacacagtggtccatgggatacggtggcaaatttttacttctggatttttttttttttttttttgaggtggagactcgctctgtcgcccaggctggagttcagtggcatgatctcagctcactgcaacctctgcctcccgggttcaagtgattctcatgcctcagcctcccaagtggcttggattacaggtgcaacaccaccacacctggctaatttttgtatttttagtagaggtggggtttcaccatgttggccaggctgatctcgaactcctgacctcaagtgatccaaccactcagccacccaaagtgctgggattacaggcatgagccaccgcaccaggccctttttgggcttttgtttgttgtttttgtttgtttctttttagagacaagatcttgcttgattgcccaggctggagtgcaatgacaccatcatagctcactgcaaactcgaattcctgggctaaagcaatcctcctgcctgagtcttctgggtagctgtaactacaggcacacactaccacaaacaactaatttttttttttttttttacagattcttactatgttgccaaggctgatctgaaactctcagcctaaagtgatcctcccacttcggcctcctaaattattaggattacaggtatgagctgcctcaataggactggagtatgagtttttgaagatcagatggtacatagagctttggcccatgtccaacccaaaggggttctaatgagttcatcgtagttaccccttcctgaaagtgtaattgaagttgacaggttcaacagctgtcaggactcttacatttcttcctgacctgtataccaagggacattattgtaagcaggaccaaggggaggcttctgaaattctactttcctggcaataaaatgaataaaacataataactgcattctccaggaaacagaattggtcgctgccacaacaaaaaactcaaaagttccagggggcggtcgtccattttatatctttattcagttaacctaactggcctctgtcaaaaccagatggattataggatgaatgcacattagcataaacttaagtcacacttgcacattcgctctaggatgtggtatcttcactgagcagaatgtggtttccagcactttgtatgcggcttttgatttagctaatgctttttaatctacacacattgtggaggaaaatcaaaacaatttgctttggtgtggtaaaaacaagaacactgcttcactgttttctgtcagggctgtcacttctgctttcagtttaattgacattttgcaaaacatcatgttaattcaatatattaataatattacataaagtggtacccataagcaggaagtggcaagttccttaagtatagtaaaatattataacattgaacagaagtaaaatactggaagaagagacataaacttcagcagattcaaagacctataacatagatgaagtttataggggtccaatgcttctggtccttttgtcaaaacatcctttttacagtaaatggcatgttgccctatatatatatatttcctatcactaaaagggaaatacagttttatgggggcttattggggttttgaattcaacatataccacatttaaggatatttctctgactcactaaaggagtttgcaagggctgcttgtctcaagtcaaacccgaaacaaaaacgggctctatagcagatatagagtctggcccaagttgcttggccattgtgccagatgatgtaacagaattcaaagttgctacaggcatgcatagtgggcattataggactctgtgcatgcctctcacaagcccataggagtggggagagcaaactcctagcgaattagtggaagactattccttctccagcagaggactaccttctgtctgaaaaacaaaacagcaagtgcagaagattaatccaagcataaagcccctctaagcataagcacttctaagcacaagaccctgtgcaactgtgaagtcatatgcctataaagccagccatgattggagggcatgagccaatctgagttgcacaaggagtggacagtattgcccacaaacatatccttcctcagattatcttgactgtcttctcttttcttggtcagcaccttgcttgatccagatcatccttccatttgggacttcaatggaacaccacactgggggcatgaggtttggctttcataactaccaccaagggactggatgatggaacgcagaacagcagagatggtagttctgcctcagggaaaccctggccaatgggaaatagaagacagaagacagctgagcagatacattttctcttctctttctcttccgtggactaatgccggctgtggtttccccttgcagcccttctggaaaagtactgggagtcaagtccacgcatctgatgaccaccatgctgtctctctcatctcattgtgaagtggtcatcagcagagtcatatcatacatcacaagacatggtttcacatttgctttgcctcaatttccacatgtcctggccattgctgccctggacttatcttccaaataaatgttatcactttaacatcagacattggctctagttctagacacccaaggctaagatactcgtttagtgttataattgttatttatgcatttttctgtgggtttttaatatggcaatttaaatgttcatttagaaagggttttaaaatattctataaaagtcacgttttagtaaggtagttggtaactaactcagttttttttaatgaaatgccatttttgtttatacactaaccagctggaaatatcacaatacaaatatatcattcacaactgaaaaattgtatgcaaagata[450 bp omitted]acaaataactaaatcagatgtagagatgatttgtcccaaggtttagataatattgttaaaatttcataactccaagaattaatacagtttatagaatttaattgtttaatgatgttatacattttcttcctataatagaacttgctattactgaatatatcaacacactgtctcattgtattatttgcaactagattataatacaacatatattttagatgttttctatcattaatacatagatttcatagatgccattttaacatttgcaaaaagtttaattcaaatgatttttataatttctatactatttttacatagagtatttttctaaggtagggaagactcaagttcttttatgtgaagtttaaaaagaatttcaagtatggaagatagaggagatcattggcaattcagggactctgaggtggtttagaaaaaaaaaacctgaaatacttgacatcagatctcaacttcaaaaaaggttttctttaactcaaaaactggaagaaatgacttttctaactgcatgttgagacttatgacaacataagtcatcacggtgtttctttcttcatccttattatagaaatgacttttttctcaaatgttcacatatttgtattaagtctattattcctcagtactgtttatggtagacatatacaaaatgtgttctaaatatatttgtcatccttgaatattattctgtgcatctttttctgaaaataattatgctggctataaactaaacataaaattagaattcatgatgaaataaaaactaccccaaagatgaaacctcattattgatttagaattgagtgtgcttactatcaaaaaatttagatgtttaagcacactgtggtacatatgtgtggtaaaaatcagtggaaaagagcaaagattttgagataatgtgtcacttcttaacaattataagtaaagatcacacagttttcaagtgaaacatgataatatgaaatgtatatgtgaaatatacatgggttcatgattctgaaaaacttcttaccatattttctataatttggcatcttgtgaaaatatgattaacattatgttattgtcaatgtcttttaagtctttcatatacagatgcacacacatagatacacttttagactaactttaggtaaaagacttttctaggtatgctttcagaaaatactcaaaaacatacactacagaaaaaacagtaaaaagtataaaatgttccagacactatcagtttgttttctcctagaatacacacacaatgtcccacttgtgaatctagagagttgagagtttcaggtctttta

SEQ ID NO: 231 - DNA, 10000 bp, Homo Sapien
ctttgggaggccgaggcaggcggattacctgaggtcaggagttcaagaccagcctggccaacatagtgaaaccccatctctactgaaaatacaaaaaattagctgggtgtggtggtgggtacctggaatcccagctgctcgggaggcagaggcagcagaatcgcttgaacctgggaggtgagccaagatcacaccactgcattccagcccgggtgacagtgtgagactccatctcaagaaaaaaaaaagaaaaaaaaggaaatgatctttgaatatagttctaaagattgagtgacttcttctgtattcttctcttcaagtgaaataatctcaacttacctaaccacaaagccacatttcctggcccttaattcactttgccactgtaatcgaaacccttaagtaaatcagagtctacccaattgtggaatgtacaagcagcacttgggtgggccatacctgagcttgaatctgttccgtgctcccttcttactgatacaacctcgaccagttacttaattctctgtggcacccagtttagtcctcaaacttgtggagattaaacaagattattctgtaagagaaagcatatagcatcatgtctgaaacacagctccacaaaatgttacttgctctttctcttcccaaacgaagtactatagagaaaagtcaattgtctataactgtgctgtatgatacagttatcatcagacaccatgtaaatatatgtggctatgtatatttaaatctatttaaattaaatacaattaaaaattctgttcttagactgcactggccataatttaagcacttggtagccacatgtagctggtgcagatatggatcattgtcatcagaaagctctcttagacagggctgattaccttatcccgttgggtgttgacacttccaaacacatccatgtcagtgtctacctaaactatgtcatgtgaaatctttctacctaaactatgccatgtaaaatctttccttggtgacaggaataaatgcaatcaccccgttttctgtggcatctcttttagaaagaacctcatctccagttccgcatccccaaagaattcagtctcactagattcaagctggaaaggcttcttctttaacctcatagattcagaaaactctagttaactgttccattgcagcccaaatccagattcaagggtcatctgcactgcgacctttgccttcctgctgagagtctggtgggctgtgggcataatgctgaaggctccaagccctggctcttgctcctaaagcaaaataccatcgctagggactcaacacagccacataaacctcgggtagcttataggcacaatatttaggacactgtgaattcccccaatgagtcccaagcaccttcacaggagagaacagtaagccaaatgctctgggaacacagctcactccattgattaggggctctgttctttctatggacagctaagcgccttcctacaagggcttcaggacaggcattatgggcccaggaacatggcatggtacatgtgtaggtttacagggctttacctaaacaaaagctgagttccccccagagcatgcaagatacagccccaaggaaccaggacagctgccttttctccaccagcattctggttccaaagctctgagataacaatcatctcggtcacaccctagatttggttaatcagatttcaatagtcaaggctggattatccatattcttcttgccaacctcacccaccctcacctctgccaagggggaagaccaaaaatgattacagattcatattttcttaactacaaatagttctaatgaaagattaggttacaggggctacaagtaacagctgaaattttatttagtggtccagcaggtttcagtccctgctatcccttctcatcttttgtgaaaagaaatccacaggtgacttcctttttttcaagattgtatctaatttttaagttaatggcaataacaataataatagcagtcacttacatagccattactttgtgccaggcattgtcctaaatgcttcacatatacacagatagtgagttgtttgcaccttactaacaactcaatgaggtaagaggtaccacaaaagcatagagaggtgaaataactcacctcggatcacacaggtcaagcagggctataaaaccgggcagcctggctccaagtctactctctgagccactgtgcaacctacaaacgataacagaaaagaacccaaagacttaacagttagagaaagcccctctgaccccaagcattctctctgttcccctaaccattgttagtcatttctgatttgtccttccagagacagtctgtgtgcacatctttctaaatgcacatctagaaagaagaagcttctgatatcaccttgggcagtcacactcatgcacaaataggagatgtttttatcttttctaataactgatatcaactttgctttccaagtccctatttgggtgcttacactggtgagtgcaggggcaaggacagaggagaaaatagtctcaacgaagggtacctttgcaaaatactccatccaccccagtgtttctgctgtcttctctgatgtgactctcagccatgatgtaggttaaagcgtctatcttagggattccttctccttccccagggtcttttttcctctctccccacaaccctgctctccctcacagccttagagagggcagcagggcttgtggagctcagagacgatgctcaaatgggaacagacaattgtccagcgtggaagcagtcacttctgacctggggtcatggcttggcctggcccctgtggctgacaaggcactactgccatggctgggagttgctggtgaaaggaaatgtcccttctccagctgggtcatcccaaaattggtggactctgaagatatggtagtcccagtgcaggtagcagctgtggtgttcccagattgtttggcttccaccacacccggcactatctccccactgcctcccacctcccacccccagtacgaggcagccttagatctctgtgtttcctgccaatactaactgcctgttggatgaaaatccattaggaattttcaaccaacgttacaaaaccacactcaggctggctttaaccatgaaatagacttactggttctgagtctagagacagggcaggcttcagatgggtcacggtccagtgggttagtaacacccccaagggcctggtttctttccaggcttcatctctgccttccactgagtcgacaccatcctgagcctctttcctgagggaggcaagatggcaccaccagcttctggggcacacacttcctctcacatgcacggtagaggaagggagagcacacactctcagaagagcaagacaacttccctccaagactccaccaaccgcttctcctgacttacttgcccaaatagggtcctgagcctatccctgaacccaccacagtgacactgtctctctccagtcagattgccagaatgaggtgtgttcagcagcactggagagaggtgagcaaaggtgaaaatcagagcagcattagcaggaagaggggacagctgctgggaggccccccgcacacctgcgtccacatgccctcacctgttcttgatgtattctcagggcttggctaagagaacctggggcctgagatgcttgggaactggctcctgggccttcttacattccacaagctggggtggccaaaggtaaccaggatggcagtgtcactatgaccttctttctccgcagccaaccacctggtctcctcatgcccagtcctctcatctgctgcgaagacacatcccaggccctctgggacgggtttgctatagactgaattgtgtccccccagttcatgtgttgaagccctaacctccaatgtgatggtatttggaggtggggcctttgggaggcgattacagttagatgaagtctaaccataattactaatcccatgatgggattagtgtccttataagaagagacacagaggcttgccgcttccctctctgctgtgtgagcatgcagtttcaggccacgtcaggaagaggggcctcggcaggaactgaatcagccagcatcttgatcttggacttcccagcttccaatccatcgaaaacacatttctgttgtttaagccacccagtttgtggtattttgttatggcagaacaagttggttaagacaaggaaaataaacagccaatgcctctcagagccctctctctctgctctctggcctctttatgtagtcaagaggataggaggggggcaagtacagctgttcaggggctgctggatacgtctacctagcatagggcacagaagccaatgctgcaatctgctcagtcagaacttaggtctcttggctcaagacctggtccctatttaaataacagtacttccaagatgagcaatgcagtgagccgtggcagccactgacactacagtacgaatctgctcagcagctccttccctggaagtttcagtgtgaggaaacatgactaggtccgaggcaagaaagagtgtggcgaggcaagactcagagaaagggagacaagctggaactacacaacaagcaagcaaggcaggcaggctctggctacgcagaacgacagcactgtaaagctcctgtggcggtcttccctaccggaggagaaactgattgaagcgcattcggaaacagcacctcatttatttacttatttagaatagacaatatacattatacacacatgaaaaaagcaaccaccacaaaagagagccaatggtgaagagtttctctctcatcctatattggcaattcttataaacctttgcagagacagtttttgcatatttccacatttatgtatgttatttttttctttttaaacaaatagcagcatactacttgccctactctacaccttgctgttaacaacattataccttagagatggttcagtatcacacacacctcaatctacctcttcttcatgactgtacaatattccattctatggaggtactataattagtcaaccatgaaacacaggtgttttcccagcccttaactcttcattgtttaaaaaaaaaaatctgtattcgtgtctattgtgtgccagtcactgttctagggaatagagagtagaaaatgagacattcagtgtcactgccgtggaggagtttacaatccatatgtggaaatgaacatccttgcacatacttctttatgtacatgtgtgaatgtattgttattataaactctcaaggtggaattgctgggtcagagccatgtgcatttctaatttcaatagatattgcaaattgtccaccaaacaggtcatgtcagtttcccctctcaccgtctgtactatcttttcatatgattaaaagtcattatagctttatataccattaggtttcttaaacacaaagtaagttctctaaaatgctcatgataacctgagcaatgactaaggaactagggaacatgacatatcaggacacccttgtggggacacatctgcttctgtgcagaggctggggcagaacctgctggctgatactttcctcacctcctatgtggcacagtcttccagcagccctgggccaggggtgggatatgatgacaggtcttttggagaacgtggtggacagttagcaatgtcactcccccacacagtatgtggcaaggaagaagaatctgtgtacacacaaaatctgtctatgaactgagaaaaaacacagggatacccatgacagaccaaggcctgatttccctcgtattgaaagagcttctacaaatcaaccagaaatccaaccaccccacaggtaagtggacaaagaatatggacagttcttgcaaaggaaatactctgtgttccagaaaatccctgtttataaaataaatactataattaaatgtctacatgcattgctgatcagcatcaatttgcccccattgtaactgttatcactatttaaaatagctaacctcggaagagtgccctgagctcacacagcagcacttggtctcctggtcttttctgtcttccctcttgcttatgactttccatgattctcaccatctcataggcaggaactgcacacacgctgcacaggctgcctgttggccactatcagccattcccacccttcccctcctcgcctcagtgacagaggtggctacttccttcccactaggcattatccctgcagggaccccactggggctctgcagattcccagatccctttctctgagtctgccccttccacttggcatgcttttgcttctgacctaaggctcctgcagctcttctgggagggctgttcttgtgctactgcccttttgtgcccacctatagaaagactgaagtacctgggttatcaacgagggtggctcttagccagtggctgacaggcatagaagaatggaagcccagataccctgcctggggcagggacatctcagaggcattgtttacagttgagagctccccttcaggtcaggctgaacctacctgtcatataactgtctgagatccttgcatggctatccttcttctagctccttactgaattctgctcggagcatttcttttaggaacaatctttgtttctgggcctgcttctaggaaacccaacgtaagacacaatcttcttcctcagtaacaaaatcctgagttttattttggcatatggccaccgtgaataaaaactacatttcccagcttcctttgcaaccaagttcttgccaataagatacagggcacaagtgccctgtgagacttctaggaaatccataaagggagtcctgctgatggctagtgtccatcgtggaccctgagggcaaggggtacatcctcaggatgtgggagcagagatctggaaaaggcctggacctctaacaacctcatggatctgccaataccaaccgcagattgtctaccatcccaccattaccccacaacttcttttgagaaataagttcctctcctgtttaagccaatgtcattcgggtgtttattccatgcagttaaatttaatcctagtttacagaccagaccattgactctgaaaaacgacagacactcagtttgccagcctcccttgcagctaggctttgccagtgtaacccagatctggctgaggaggtataaaggaaggtcttggggggaagaaaggtgtaggcaggaggttctggaaaagatatttcttcctgatgcaaaaaacaaacaggtgcacaatgtccagctctctttccactctggcaacctattccctgctacctgcctttggctgcagcatgtgaagatgtgctgtctggagctgtggcagccattctataaccaggaaactacaagtgcatggacaaaaagccaaccagctgaggatggctgtgcagaaggatggagagagcctgggtctttcagaaactcactgagatctcccactccaaaccaataaatggtccacactgttaatcgggttttccattacatacagttgaaagcaatctaacatactcacagggaacaaagcactgaagtaaaatcacctggaagtgatcaattctcaaaaagcctgctactataacctcttggagggtgctatagtttgggtgtttttgtcccctccaaaattcatgttgaaactcaattcccagtgcaagaatgttgggaggtggggcctagagtgaggtgtttaggtcataagagtgggtactctctcactcttccagcatgtgaggacacagcgttcctccccttcataggatgaagcacgcaaagccccattttggaagcagagacagagctaagaccccaccagacaccaagcctgttggtgcctggatcttggacttccaacctccagaactgtgagaaacagatatctgttctttataaattacccagtctcaggtattctattattgcagcacaaaacaaactatggggagatgactgggttctgggaggtgattacctgtgctaggcttgcctctgagggcaagaaacagcaactccagcttcagggaagtgaaataataagaaataaactccaggatccgctgattcctgtgttcaacaatgccatcaggaacccagggccctcccctctctctgctctgccactcttgaaatgggcttcattctcaggcagccagcaagacagaggcatgcttctgggcagcacagccagacctaactggggcctatcgagggcctgcactctcccccttggcttctccctccagctggattttcttgcttttcttcaaacatgccagataggctcctgccctagcctctgcacttgcgttccctctgcctacagtgcttttgcatacatgtccacttggctctgcctccttcaggtcctcacccaaatattacctcccgagagaggcctgccctgaccacaccttttaagattaaccacctcccaactccccatttctttttctggcttaatttttctccctggcatgtaacttcatccaatatagcacacattcccttggcctcactgagtgtccgggccccacttgcctagaaggtgtgctccaggaaggcagagatgtttaagattgttcaccctcattcccccagggcctggcacaggtgtttcacaattatctgcagaaggaaggaaagacagacaagggacagacaacagccagaggaagaagtgcagtaagacaggatctttccagagatggcaccacgcccatcaacccacaggctttgctcaccatgcagaactggcacatgcccactctcaaccacccactggcaaaaagagatttcctttagccccacaatggcactggggtccacgtttggtgcaggggtagacccctgaacaaaatgcaggatggagaaatggatgttgggagtgcctagcagtaccagttctcctctctcagccctggttctccaggactttttctcttgcctacggtttaaaaacaatggctatcttagcccttcactgccacctgtctaaaaagagttgccgccgggtaccgtggctcacgcctgtaatcccagcactttgggaggcccaggcgggcggctcacgaggtcaggagtttgagaccagcctgaccaacatggtgaaaccccgtctttactaaaaatacaaaaattagccgggcatggtggctgtagtcccagctactcgggaggctgaggtagaattgcttgaacctgggaggcggaggttgcagtgagccaagatcgtgccactgcactccagcctgggagacagagcaagacatggtctcaaaaaaaaaaaaaaaaaaaagagttgccaacacttgctgcctccattccctgaagccccatccatgcctcaccccgctggaatccgacttccatccccggcctttaaatctgcctcgcacagtggttatcaatgtatcaatgacctacttgcttctgagacaaatgggactctcaggccttatcttaccctgccttgctgcccactcctccctcctcggcgcctcttctgggcaggaccggcaggtgttcaggcccgtccccagcccctggctccggcgtcccgggctccctgccggcatccaccttcacctcctccccagccccagccctctggcgacttctcccacctccacagtggctgtgccacgaggagccccatcaatgcccgctgcggcctgcccctttctccgccgtcccctttcacctgctgggaaatcacagccctaatgcttggagaatccaagcagtttccctctaaaaccccagggttgcgaaaccgcaggggaaacgccaagtccctgagctgggctagggacgcggtacgaggtagcacgggcgggccgcgattcctcggggaggcgtccccattgtccccccaaccccgaccctctcccgccgcggcctgggccagaagcacccggccctgcgctgcggaggcgatgccgcatcctagcactaagcccgggcagcggggaggggca

SEQ ID NO: 232 - DNA, 10000 bp, Homo Sapien
caacaacacgttgaggtaactaaaaattagcaagaccaatttctctaagacatgcttgaaaatcagtctccctattttataaaccttaggtatcatctaatgataatatgtgtacatatttgaccaacagaagaatgatggatataggaataagtatcattataagcttcacatgtcaaaagaaacagacatccaaataaaaaaagataatatatgaaagcctgaacatgacacacaatggtacattttatgactaaataaaatgcttagatagaaattctttgacaggtgatacaaactctggattcctccaagtcatcatgagaatggaggaaatacttttctctttctttccctattccttttcctattttgtgtctcaaaatatttcctaaacaaatctagattctctctataatgtcctttctcctttgcatgtaatgacattgggagggattggtaattctgctgcggacttcaaataataacagagaagactttctgttgcacacttacataaaagttttagtatttgataacactgcccatgcaagtgttacttacatgttacttatttctatatccatcattcttctgttggtcaagtgttatcctctcactctaaataaattttttatttagctgcatagaatctttatattttatatttgtttccttagtactaaatgtgatttacttgaccatgaaactactatttggaaatcctagaatgaaaacagatctgtttgttacccacttgaactgagtggggagactgagttatagctatactcgctaagtggttacaataacttggagcaagataaacattaaaaattaattttccttgggaagttatagctgagtgtggagatagctacatgtgtgtatcccctccctcccagtcattcattccccttctccaagctgtatatgctaatttttttggaggagaaattgggaactgttaaacttgcagttagacaaattattttaaagttgggcattttctaaagtctaattgggccaatcccacttttagttttgcacttattatcactgaaaatagctatgtatattattcacacacagccaaacgtatgtatgatgtgtatacaaggggaaaaaacttttttttggtaataaggccatgcctttttttaaaaaaaaatactgcgtgttgtaggaggtatgaacccgaacaatgtcgtttaagttctctaggactttgagggtaaacataattgagattaaaatactgacgtgctcacatttagtagagagataagaataattcatcgggagctattctagtctcactggtaatcacataattcaacagggtttttagagaatacctgaagctatcgtcgtctgttgtgcaattacataattagtcaggatctctgtaataaaatcttttctaaatgtatgtgggttactactaagtaaatgttagggctagtgttatatttttacttttaatacttgtataacaatttaaactgttaaacattatttcccgacataactacagatacttaacatgaaaagaattgcattactcaaaaactaagaaaaaaaaaatccccctacatatatttgtttccacaatgctgatcaaaactgcttgctttatgaacattaactcactatccaatctcctctagagtgtttacttctgggaactccggggttgtattatctctttggtgttggttgtttcacccacttctaaattactgatctatttttttgatattcgcgtgactacctatcaatataagtcaaagtgcgctctttctggtccttttgctttaatgataacgctgcgcagccaggaacatttcgggagtcctcctacacggaaacaaacgtggcctggcgaagttgaagccagcaacgtggcgggaagtgaggaagtaacagcaattccttattctttatcattattgttgttttagagtctttccgcggcgttttcggccgggttcctgctccagaaggccggcgaggggccccttgcccgcggcgcgccgcagacacacggtcgggaagcacaaaggcgcgcggagcctgggcagcagcccccgagacggtcacgccctcgccgctctccggccccatgcggccgcacaaagaccagagccccaccgctacccacgcacccacccacgctcgagaggggcgccgcgcggcgcaggccgccacacccactcgggcccgctcccgcctcccgggtcccgggcgccctgatgaatatgcatcgcggcgcgcccgcccccggctcctcctttcggtttccttcccgccgccaggcggaagcgaagagccgcgcttcccgcgcgcccaggccggccgtggtagggtggggcggggcgggccgcgagccggagaaagagaaagccagggaggcgactgcaggaggagcgcgggccgggcgcggaagggtgcgctgctgggtggcggttccggggcagccccgccgcgggccaggccaatccgagggcggggaaggggcgatcgcgcgaccccggggccgtgccggctgcatctgaccggcgcagccccactcctggagcagccccgctaaaacaacaataaaacccaccacacacacacacacatgcacacacgcacacgcgggcgcacacacacacaccatcctggacggcgttcaagtcaagcacgagaaacagccttctgcaagggagaggaaagaaagctggaaatccagacagactgaagggctgcctgcttttagacttgactttgaccgccttttcttctcgggccaagaactgtggcagtgcagaaattacaattaaaaaatacataagactactcccggattgcttttttttttttttttttttttttaactaaacacaaaaagcgacaccaaaacaacccctgagaaaatccacaaatctgtacctgagacacgtcaagtcagcggcccagggttctgttacagactcaagatctcttttatttaatgcaatacagtgcgatggtatgtggctttgaactgatgggttttgtttgcttcttttattcgttctttgcaccccctcctatccctggcacagtttttcttttcctgtttgtggattgcaaagtggctgttttacccctttcctaaatgtcatttttgttttacaggttgtgggctatagtgctgcatttgcagaactaatttgcaaatatgcattattatttagcgttggcaactttagtacatgtgacacactcttatgacgggaatcagtgagtaacattgtggtccaaacggtgcagaatctagcattttgttctgctttaactctctgctttatgcccctctcccctcagtggtggaaaaaaattactgttcaaatgatactttagttctaccttgtaggccattctctcctcttgaagcattcttttctccattttaattcacagatattctcatttaaaaatacatttttaagtgaaagaagtactatttaactctgattggtgtgttggaatgtttaaagtcagtattcattctaaagtttagtcctaacccccatcccctcatccctgaatttgtggcatcctattgttagcctttcttccgcaccccccaccaactttttaaaaccgattttgatggatttctttccactcctgttaatagtttccccccaaccccgctatttttgctgccgatttttttcctcttcctatgtgtgtctctatctctcgttctccttgtcttcttttccccaatacgtctgagacacattttaatgcacaatatcccatccattaagttgtggttgaatgtgaagtgtgtgaggacttggcagctttcagattgaagggggcggggaagccagtttcgactttgacacaagatgctgaagtggcgtgatcagaattattattagggctgtgaacatggccatcttctgctcgggttggaagaactgccactgaacttgagacaggacagacaagatctctaagtatttttcccccaccccccaagtacagtagctggcagggaaaaggcgccaaaatacacaagattaactctgactttctttgaacggatcttatagcaccatccttgtaactttaacttccaataggcgggaaaaagttaacttttgatcccacacttgaacagacatttaaatcagccctaaaatggaataagtccagaaagtaacacacgcatgcttatgtggttagaaaagaatgcacgtgtaaataagcagggtgtatgtgtgtatatgactgaggagttcaagatttaatcaaaatcagaattagtgtgactttccagtgtatttacaatatgaagaaaagcattgtgaggcaaagaaactgacctttaagcatcctaagtaaaaactgcaaagagtttgtgaaacacaaaacgttgtggtttccagttttacatttgaggtttgatgttttcatttaatggtatgagagatggagaaagctctagcgctgaaaagtccctattaaatcatatgtgggcaaaggtcaagcactccaactcactgacgcaatatactacagattcctgcctaagtgatgaggaacacaggaaaaagtactttggcaataaaattattagaacagtaattatcatcggtggttgggactgcattcttgtgcactgggaaaacgtttttactggccctgatgaattttaaagccaagtattgttgaaagctattttaataggaaattgattagctgagtgttccatacaagaaatggtgacggtttcattgtttgaggtccaaaataaatttttattctttagcagacataggcatccctttaattttaatatggtcagactgaacagcagcataattttgagtgaatgtgatgtcatgaacatctgtaactttgtttttggagtttttgacattacacaatttgataatattactgctttgaaatttattggcttgtgtagttaaaatttcagatacactcagagataaagtttactgaacatatattttgtttaggcccaattgtttgtgttttttctttgtaattacaaaattgtttcttaaattttaatttgaaaattaaaatgcacaattctgttgttatgcattgctttgactttgaaattttgttgttatgcattgttatgcagttttcaaagaagaaatgagagaaaggggtgcagaaagtttgagttgctctgccatgcactttttatacttaatacagaatgtaaagactacttagccattttggacagagctttctatacctgtcttaaaaacccatctgttttcctatgttacaaggcatgtgtatatgggtaatagaagccagtttacctgtagaaataaaatggtcatatagttttactttataggtcagctattttgaaaaagagcaataactgcaactctctcaatatcagcagacaagagacactgtgtgagagagtatatggaacctttgtaacattgtggataagtgaggcaactattacctctattttcaaagtttaaaatacatcatgcaaaagttacagggcaactgctgactttgtaatctgtgaagcaagtgtcttacagtgttgggaatctctgttgatgcactggcctcatctctgttgagaagtgaaaaccggataaccttagtggaggaatctggctcagttggtgttgagatcagaactgtattataacttgtaaatatgctagaaatgtagacacacttagtgggatgctttttttttttttttaaacagtggagtagaggcatttcggcagtgacattattaacagcgtcatttttctcatttacttttgtcctcaggggacaccaaatagctcccagaggaggagaaaaaggtccaaggttatttattcatttcagtgcaaagggctagcaatgggggtggggaaactaaccagttgtgaattctctggtggggaaaaaattactaccctaatttgacagtagtacgttaagggctgggtatgattttgttttttgtttaagagtagtagacagtagtagtagtactcagtagtagtttaagagctgggtaatttgattacctgagctggtaaaattgattttgcaattctcatcaagtacaggcactttcaatacttcttgattgtttatatatgcatttatgagtggatttttggtgttcctccttgtggatataaatttgtgttttccagactacacatgtatgatttttgtggttcatttggaaaaaggaaagatcccagggcatggtgcagtagatacttgcagttttgcaggcctgctttctggggtcaggaggtcatctgtctcttttgcatttagtttttaaatattgatattggtgatgcagccagggtgtgtagaatagttgaaccttcttgcaaaccacatgcaagagccaaaaaaaaaaaaaaaaaaaaaaaaaaggcatcgagtgtattggaaatgacagctttgttaagttccaagaaatctttcatgaaactgcccaggatttgcaacctgtcgctgcaatttctttaggaaggaaaaggttaaaagaaaaacaatattagatacttgagatgtcaagctcctctctggagatccgtagtgaaaggctcaaatgtggtagcgttgcttatttcaaatatacaactgggttttgaaaaatccagtgagctgaagcactggcattctatttagaaatcaataaactttctgttagttagaaaggaaacttttttttttcccttataaggcagcaaggagatctagggaggagatctttaagaatactgaaataacagagtttcctgttgctgagagaatcattcacttctttctgcctcctcagccaggttttggggtgaatgaaagtggcctgtcacaccagtgcttttaaccctctcagtgtgggagggagagatgaagagtttaggattggtaagtaccaaagtttaagaagtgtttggcccattttgatactatcagaagcttttcagagatatttccactcttaataccacgacacagacgtgctagaaaaaatggaaagtgaatacaatgcaggcactttctcagttcctccttctacctgggatttaaaagattgagattttcaaaccaaaggtggtggacaagtgttgtgttaagagaagccaggcatcccatgcaccgaaatccaccagtccctctttccaaacaactccctagagttcttccagggaaggcctgcaatgaccttggcattggctggacaagaagaagtgttttggggggtgtcagccattctccacatggctgcaaggcctgagaagacagtcaaagccatagaaactgagcacccccataaaccttctttttcaggaagtctctgttgctcactcttcattcctttttggttttcctcgcctcaccatactcctatctcattttcctttttctgggaaacaaatcaaaaccaaaaactatcaagcatcctctatggtcatcaaagtgcaaccagccataagcaccctcaaacgtggggcaattgaaagagatttgaacccctaagtgatgggcctgggaggccccagacgtcttcacttctctggggtcttacctggatctgacgctgcttcttcgcccttggtgttgctgaagcttttgtgggctcttctgtgtaatacttgtcaatttttcgtttttcttttttaagcttgtgaaaaacttttggatgcaacctagttttggtggcagaaggaaatggtttctgttgggaaagggaaactaataaagggaggaggggtagcgatgtcgggagacacttgcccagggctcagccctgggcctctttttgccaggggacaacggctggttctgggctctcaggctgaaaggagtgctctctgggtgccaggatttcactgggggtggtgtggtgaggagggagggaagaagggagggagggagagaaggagagatgggcgctcgatttttaaagagaccccgaaataatggcttctatgagagtccaggcattcaaagaggtgtgttcaaggatattagtgcattcctgccaaggggaatgtcttttatggtaaattaactccagttaaattgaatatttgttcaaagggaaactgcagtagttaaagctggtattatcagtagagcttccccaccccctcccctcagaatctggtgagggtgagaaaggggatgcagtgtaatgtgcaatacaaagtgatgctttcgtgctggtggtttctctgtgtgtgtgtgtctgtgtgtgtttaatctaagatgaggttgcctaaaatttctgagagaaatgagtatttacttggattaaccctgtcacctcatttctttcatccataaagactgccaactttatcccagcttttcaaaaagaagaaatgacccgcacaaaggaaattaacgttgtcagaacgctgactccaggatttgccggggcaggggcggggaccgcagggaggccgctcccagggcgtgtggccgaaagggttaactcgcaggggtccgcgcgatctccccgactttacctgtcttcctagtcccagcagcccccgtccccggcctcccgaactccccaccccccagcgcctttcttctttgggctctgggtttacgggggctgcagctggtaaacttggcaagctcgcctcattaagagcgctctttgaaaacggactgtgtttgagcatttccctaatgaggacaggacggggttaaaaagtgaccatttcatggttgacttgaacctgcctacttttcttgatgtgtcgttgtgaaatgcttgatgtggataactcccacttggtgaaggaaaaagtcactggttcctccaggtccgctgggggagggaagaggggacggtggacagaaaccagagggagtgagaggggctaaagttgaggggacagatcacgagctgggaagcggtggaaagaggaccggggaatcgggggcgagcctcgaaacgccccagcagtacccgtggaagcggggcggccccgccctggggatgggcccgcgaggacccggtagccccagcgccccccggatcccccagctaggtagactcggagccccaggcgctcacttttcctccctccattgtctgggaggcctttgcttccccctcgtccccatccaccccaagcagaaaactggatttggggggcggtgtgtgtatgtgggcggggggtgcagaaagggtgcaaggcgaaccgccttcttcaaaatccctggaatcaagttcattcactcggagcctgcacgggcgacggggtgggggcggggcagcgccgcggtggggagccggcgcgggcgccgagcggctcagggcccgcagcctctggagggctgcagcggcgcgcgcgcgcccgccggcccgccccgcagccccgggcgcgccgcggccccgccccgcctgcacccgggcgggtagggagacgctttccgccggcgccccgggccccggggggtggggattgggagccagccagcggggctgcaggaggaggaggaggagagcgaagccgggcgcggggaggaggtggagggagcaagaggcggcggcggcggctcggcccggtcctcccgctcagagcgaggccacgtgcacggggcacccccggggagggcggcaaaccgcggcgaagcgccgcgcgccgcgactgcctcgggtgcgggcccctggtgggcagacccgggacgaacccgcaccccctccctatccgcgaacccgggctccgggcggggccgtcgggggctgggcgccgcacccccctggtccacgccggcgcgccccaactacttgagcccaagttcgctcaggtccccgcctgctcggcctcccccttttcccggcagccgcaggctccgcggactgagcccgccccgggtgcgagtgtccgcgccccagccccggcctgggggcggcctgggtgtgagggaattttccactcgttcctttctcggg

SEQ ID NO: 233 - DNA, 10000 bp, Homo Sapien
atatatcatagttattatccagaatattttggttaatcacattattcttacttttctaagtatagaaaaataatttttactattgaaaattattcttatttataaaatgttttgtaattttttacacctatactctctctccaatttttctgtaatacattatttcatcaatagtagcaattttaaaactgcttattcacatgatacacactcaggcattctctattgcacaatgtattaactgtttactaattttttctttccttggaaaaatgacttaatttgtacaaaattagaatagaaattttgttactctaataacataataacacagatatattattttttaaattaacaagtatacatatttcaatttgcaaggttagcttgtcagagtactctatttctttaagcaacttaattattttaacctgattttcccggtgaataaattttcacactcaaagagaaaagcagtctttataggagaagtgaaaaaagaggctaattttaaatgaacattaaacccagtgaggagactatagtcttgctttactggtgccacagataacatttggttgttttcaaatatctttttggaagcttccatatgttatttattgtaaaaatgtccctggttatggcattatattaaatcagcacctcttagtataaaacttcaagtcctcggagaggcattccaaaaggccctccatatgtactttccagcaagcatgtggccttgtcttgccccacccatcacaccaccttcctatcccctgaccagttacacaaacaggtgcctgagcttttcagagaacatgttcatagaagaagccattcagagagattatacatatactcagaaaggctctttcttagtgacagtttttggttagttttaaattatagaaatttagctggtttttacatttgtttggaaaattgtttctttggcttcaacaaagtgggcatgtgtcaaatttgttatttggtgattttggctttctgtgaattgctttttggcaaattaaattgtggagaattgaccaaggctaccccaactttctctctctctctctctctctctctcatgtgaagacacactcacatcttactgattgttccttctccttcctctgtcatatgatggcactttgagaaaaagccttctagttttttcactattgctccaccattagtcatgtgcatatctgtgtcccctaaccctagagcagctccttctgcactctcctgagtttcttgagggcagatactcttactaatctctgtatcctcaatgtctagcagagggcctgggacctgtagaaaagcgagcaaaaaaaactttttgaaagaatgagattaaatacatctgctcaggtaatacaaacatttatttttaatttccctttctgaggaacaatgccagattcatgatatccttaataaaaagattcctggcataagtggctcttcgcctgtgtctttcctagaatgctaatttgacatttgcacaaaaggtagatcagtttgtctgactgtggaggggcagatgttgtcagtcttgattgatgatgatgctctagagtctaaccctcagccacttgtggcatttcccatctggtcttcacaccactccatttctgctattaacattaaactatccaaatattcgaattgagacttttaaaggaatagtttgttttttactgacctacccaagctagaggaatgatttataagaaaagaaagttactgtgactgaaatagacacacacacacatacacatgggtggggtgtacacacacacacacacacacaccagcaccaccttatgttaccccgaggtattcctggcagtttcttgctgattttagccacagtctgagtaatgtctgcttgcctgagtgttgtaaagttatctccctttattagatgaactcttgaatgaaggctggcggtactgtgtcttcctagttcaatatctgttgtctttctgccgcctctctgcagactagaggtggctgcaaaggatgccgtggaaacgagagaggagtgctgaaccaaagcatttttcaatgcaaagacttctcattgtaactcatagagttctttaaaattgttttggggaagttttgagtgttactctggccttctcacttttattaaggctgctaaaatggagccatatataacacagatttgaaaacataatcaatatagcacttggaattgttacttgtaaatatgagaattctaacatctcctggaatattgcaagttctgtgaaactatttttttacaaaagcaaattataatttatttttataataactgcctggacattctgataaaatcatttccaaataaatttgtcctcattgaatctaaaatagtaaatgaactatttaactaactatgcaattttgattagagaccaagaaaatcatgacagttataaaggcttgagagactatcaaaatagagtgctccttatgcctagctttttttttttttcttttacatggacactgctaattggaaataacttgagataagctcagatgaatgtttccattaacacaaagcagttggggaagactaaggccagaggttattttattatattcttaaaagacatatatgtcttataaggtttggcttttgttcttaaaatactagaccattcaaaaattgttattaaatatattcaataaaacaagaagtacctaattttttttgaaagggaaagaaaatctataaataatggctaagtgaagggaggtcgcagactgtctaaattcagccatgttcctgccttgttactgaccattttatcgcaaagtgaaacagtgtgacatattgcactggaataatgatcctgaaaagcaggaaataatagctttaagttagggaatatactagcatacaaaccaggtattaaatcttatttgtgtaaaaatgcatgtttttataaaaatgcttttatgaatgaattgagtattttatgagggatacacaaataaatgttactagtgaatgattgcctccagaaaagggaactggagaacagggatgggagagagacttacctttcaatgtacattctcttgtacttcctgaattctatatcacatgcatgtattttctattaaaattatttatttaaaaaatgctctagctgggtgtggtggctcaggcctgtaatagctatactttggggggttgaggcaagcagatcacttgaggccaggagttcaagactagcccagtcaaaatcacgaaaccccatctctacaaaaaatacaaaaattagctagacggggtggcacagtcctgtaatcccagctacttgggaggctgaggcatgagaatcgcttgaactcaggaggcagaggttacagtgagccgagatcgtgtcactgcactacagcctgggtgacagagcgagactctgagattctgtctcaaaaacaaacaatgttctaagcagacaactccaatttctatcatttctacaatcaaacaaatattcaaatcaaaaactaaactcaaaaaagatttgtatttaaaaaagaaaaatcttccaagtctcctcaaatacatgacattaggatttgaactcaaaggtaacatgatgtaggagcacttattttccacggataactatggaaacacattcagttaattaataagactccaaaattatttaagtatatacttatagtgaaatactttataaaaaataaataatactacgcaagagagttattaatattttacagatgagaaaactaagggtcagctgactacataatttattcaaagtcacaaggctggtcctctacatagggcaaattatagtaacatttctgctgtgtagtaaactaatgaatgatttcaatccttactagaacctatgtttggaagatttacacttcagtcactttagtgttttgctttaaacataaacatcttttatggaaggctgttcatattgtcatcagtatgctttaagcagttcataatttatagcaatgtttaatgttgctcaagtatccatttgaaatgcattatagtttcactgaaaatgacccttttgggaaggcagccttctggaaatggcaatacatttctagtgtttttaaaggatattttaaaaatggcagtcaagtcatttatgagttttatcttgttgcctgacaatttttaccacaaactgaaagacttaaaaccaacttatctcacagttttggtagtgagaagtgtggggacggcatgactaggatctttgcttagggacttacaggctgaaatcaaagtgtcagccatgcttccttttcacctggagctagaggtcctcttcccagctcatgtggttgtgacagaattcagttccttgctgttgtaggactgaggtccccacttccttacttgatgtcagctaggagttgctctacatccctggagtccacctgcattccttgccatgcagcctgctccattctcaaagcccgtaacaggagatctctcttgagtccaatcccaatcacatttcaaatccctatctcaagaggagcctaatttcttttaaggacttgcctgattaggtcaggcccacacaggtaagttttctctcttaaagtcaaatgatttgagatgttaattatagttacaaattctcttcacagcagcacttttattagtatttgattgtatattgattgagtaactgggagaagatgctaccaggggtggaaaacttgggggatgtaaatgcagtataaacattcccaccaccaccaccaatcctgtccccatcccctactctcttcccctggtgagctatccttccaccaaaaagtcaaagaagggattacattaccatgttacttatatttatttatatagagttaaatttaaataagaaatttaaatttggctttcctgttcatttgagtcttaaaggtctaggtgcaagagaatttagtttccctatctgcactttatagttgggataattgatggtcagggagatgaaattattggcctcctcaagttacatggcatccctatcttcatattttaggtccatggttttaaatttactgcagaattttatttctataatatattaaatatcacaatttttaggttagttttatttttcatgatctctaaaaagaactgtttttttttcaaacctgtggacaaatatcgcagaaaataataaaatgcaatggtcttactgttgtatgcccgcatgagaaagaatttcatttacatcaagaggaccacattgtgaaaagcatttatatacatttttttctataggaacttatgtttttttgttttcttttttaaataactgtatgggctgggtgcagtggctcatgcctgtaatccctgcactttggaaggctgaggcgggtggataacttgaggccaggagttcaagaccagcctggtcaacacggtgaaactttgtctctactgaaaatacaaaaattagctgggtctggtggcaaacacctgtaatcccagatacttgggaggctgaggcaggagaatcatttgaacccaagaggtagaggttgcagtgaactgagatcacaccactgcactccagcctggatgacagagcaagactccgtctcaaaaaaataaataactcttatgattctttatggaaatccagaaaacagaaacgaactatttttgaagtttgtttaattaaggcaacacttcatttgccattttcatcttctgtgtgttggttaatgtcaatgtgggtgtgtttcaggacttcaagattttatcttactcaaggtgcaaccactctttatgatcgaaacaacatggctggttcaggtgacaatgttaaagccacatccagtatgatgtagaattaatggaaaataatcttctattaatcaaaaagtacgctgtaattttcgtaggaccaaccagactccatcttaactctttcttctctcaaagttttaaacatagctgaagttattggatggatgctgtctgtaagaacagattgataatttcagaatgtgagtcacagggaaagtggagttccatagaaccattgaaggtagcaaggtaaaaaggaccataggtaacttctccttttacaaatgatgaaagtggatctcagagaagttaaggaatctgcctaagggcacacagctcaagaagtgatagaactgagatgtgaatatcaatcttttggttctaaattcagtcctctttagttcaccaattgcatctgttggtgcaaaatgtattgtttccagtttttcacaggtattgccattttttacaaccacagcaagtatttgggaataaagatatggtttgaattttgtgaatccttacctgtttcacaagctcagatccctgtctctattttcatttccccaagcctcttttatgggctgctgccatccatgtgatcctcactctaaccaactgcacatgataattttctttggtctgaatgtgtacaatatgcaccaaggtcagtattattccaaggggtggggtgatgagagtggtccacctgctcaacagtaaacacagtaatcctttgtacttagaccaagagaatatttttgggaggaggaggaatattttattactgatatttgtaacttctagtaaatagagacaataaaaagcagattgacttttagtcacttttattattgtttctaagttttttatagacctgttctcccaatggcccctgtgacgctgtcctggattaaagtacaggaatcccggaattgctgcttacatcttacacactttcagcctttctagaaagtgctccttattagacagaagagagaaagggaggcaaaacacaatcataatttttgaaagcacaaatgcttaaaaattgaaattatatatgaaatgtataatatatcccaaaatatcactaggaaaacaacttcggtaaggaaattgattgttagacaccagaatcttatgaatttttctgggtttatatgtgattttacacttactgtgtccccagcaagaaagatattttagttttgcttgtcaccgggctcacagagaagtgaatattttaatgcattttgagtagaagcagcgctgcatagggtattaagacagcctgggtcaaatctggacaatgtgaccacgggcaaattatctagtctggccaagcatcagtttctccatctataaaacataaatgagtaatagtgcctatcttacagagtaagtgtggggattaaaatcaattacataaagggcttagccctgtgctggcacgtattaaataataaatgttgacaatcatcattgtcatcatccaggctaaaagatattaaatgtaaaaaaaaaaagatttttagtctgacacaaaattctggttgttttcttcatttctcacaaatatgaaatgaaaacaccagtacaggtatttaaggacataaccccaacttagttgtgattaagatttttatttagcaaatttctccaagggcactagatggcgaccttgtcctttaagaaaaaaaaaaaaaatctaaggtttcattaattctctgctttgacatattactgctacagatttagaagtaagaaacagaaagtaaggtcacatctttcaacactggatcatcagaatcataagagtttctaaattttctggatctaggctaggagcagcatgggacggaaagcatgcttcgtgggtattaggcgtcctggactcaaacttctgcccttgaagtgatcttggactttccctctcaagatctaattttcctcctttgtaatatgaggttgttgggttagatcatcttcaaagttctttcagctgtaatatactatgacatgttttttaataattcagtgtttattcttctaccagcatgtcttttctcaagctttccttgtggtctaaattaaatacttcttaagccaatggacaagatttaacgtcactagcaatcaacattatttaaattaaaactgacctattcaaaaatggttttattttggaagatggggatgaattttgggttttgaggtgcatgcgtgaaatctaagtttaaaggtttattttttaataagcagaagaaacatttgaatatcttcatttaagatagtgtaagacttggaaaaaaccttttaagagtcattttaaaactatttttttcttctgtaaataaagttaaagctatgcctagatttttgaatgtgatcaaaggttttttctaatgtattatttttaaatgtcaattattttagtgtgtgtaaaatgataatagcagattaagttcatagacagaagcaacagaatagcaactgtcaacaacactaagaaccctttctcaaacatcagtagacatagccagactttagcatctggtgcaattaagaaattcagatgtggtttaaaacatttttaatgtacaataatcagataagtagaatagtaaataataaatctccagaataaaatatacacctgtttttcctttatttagttgtttcagaaaaggtagaataattttttttttgtaagtagccagtaattatacattgatttttcttttttaagaaaagttacaatttaggaaagaatctcctggtatcttagttgcaactatttttttccttaaaaaaattaccaatgtgttgactattatcagaagaaatacttctcattccctatcaaatcaaactctcaaatagtgacttatgttatgtaaatgctctctgtgatacatagatataaaaaaggaaattgtaagaatccgtgaatacgcgattattctactgtgcagaataatccttttagcatagggtagatggtggatgcacaggtaagacctaaacacagataattaaagatgcaatttctcccccaaactggaactggtagtgtgacccagcttagcactggtggccaccacttctgagccattgaggaagagattgtgatataatttggatgctctgtatacaagactgaagggtagtagatggaaaaaaagccagacacaaaaagtttacagttaacacatggcctttctcttttccgtaatcatttggctcattaccctatgttcatccaacttccccaccaacaattttagttcactctgtccagtaaggctttacgctgaaaaaccttggaactggtattgccctgtcattcttactagggtcagaaccatgagacttcaaagtaactaacacacacacacgcacacacacacacacacacgccttcctttctgaatccatccaggcatcaaaaatagaaaagaagtaaaagtcaaagaccaagatgaatttgtgcaggttactgtctaaaggcagtttaatatttacgaaatgtcacacacatacacacacactcacactctttaggatccagttacaagcgctgcgtcatccgccagatcacatggtaattgttgctatttcaaggatcaagtggcataaatctccccccccccaccccacccccttcccttggtaccatatagcgtggaagagtgagttttgtgtgatggagtgggaccaggctctctgatccaaccctctgctagcaactcggctgtcggtggggtggcgcgcgcgtattctcacggagtgactaggagagggggacgagggagggggtctcaggggaggaagggcagctctaattggtttctcaatgaaagataatcacctactccccagagaggctggagattagcactctgcctctcctctccatcgcttttagacttctcatcctcccctcggtgcttttagtccattcagcagaagcggatcgaagcaggaggctccccgcgccgcattaggggcgcactccgccgcgctcgagtacttagcgcccattcactcgctcacccgcgctctccgctgccggctgccgtcccagccgccgccgccgccgccgccgccgccgccgcccgagaaaaa

SEQ ID NO: 234 - DNA, 10000 bp, Homo Sapien
ttgacagtttctcactagcaaaaccctccttggcctttggtattctcaccactcactctctctctctgttttttttttttttttttttttttttttttttttttttgagacggagtctcactctgtctattgcccaggctggagtgcagtggcataatctcggctcatggcaacctctgccccccaggttcaagcgattctcctgcctcagcctcctgagtagctgggcttacaggtgccggctaccacgcccagctcatttttgtatttttagtagagacggggtttcaccgtgttggccaggctggtcttgaactcccaacctcaggtgatccgcccgccttggcctcccaaagcactgggattacaggcatgagccactgtgcccagcctcaccactcactctcaaagagagttgctgttagtggaactgcaagtccctgaatttcttctacagatttatcacttgtaagaaaataattggaaaaattccagggagagatgtagctaacagagagcatgaaagacaaagcccaagtagtatcatgtcaatgttaatttcttggtattgataattgtaatttggttctataaagtgttagcacctgggtgctggagaggatgtggacaaacaggaacacttttacactgttggtgggagtgtaaactagttcaaccattgtggaagacagtgcggtgattcctcaaggatctaaaactagaaataccatttgacccagctatcccattactaggtgtacacccaaaggattataaatcatgctactataaagacacatgcacacgtatgtataaaggcactattcacgatagcaaagacttggaaccaacccaaatgtccatcaatgataggctggattaagaaaatgtggcacatatacaccacggaatactatgcagccataaaaaaggatgagttcatgtcttttgtagggacatggatgaagctgcaaaccatcattctgagcaaactatctcaaggacagaaaaccaaacaccacatgttctcactcacaggtgggaactgaacaatgagaacacttggacatggggtggggaacatcacacactggggcctgtagtggggtgaggggagggggagggatagcattaggagaaatacctaatgtaaatgatgatttgatgggtgcagcacaccaacacggcacatgtatacatatataacaaacctgcacattgtgtacatgtaccctagaacttaaagtataataataaaaaaaaaattagcacctggggaaggtgggtgaaggctatacatgaattaattggaatacttttgccacttaaaatctgaaattatttcaaaatgaaaggttaaagaaaatttaaaacttaaaaacactgaactcctgatcacctccatttctactcccaaacctgctccacctgcaatcttttccatctccatggatggcaatttcattcttcttgtccaggccagaacatttaaagtcatcttttatgtcttttttgccctcctacctcaattccaatctacaagacattttatgggctttgtctttccatatgtccagtatcaaatcacttctcatcacctctcttgctgcctcccagtccaggacattgtcagtgcttgcctggattattgcaacagctttctaatcagcctccttgatctacttctcttctcctaatgctctaatggttctcattttattcagagtaaaagtcaaagttctgactatagcctatgaggccctacatgtttccttcactttctacgcgatctagttttgatctcctcttttactactcactcactcacttgattcaaaccactctgatctacatttttagagacatagtcttgctctgtcacccaggctggagtgcagtggtgcgatcatagctcactgcagccttgacttccccgggctcaagggatccttctgcctcagcctcctgagtagctgggaatataggcacataccaccatgcccagctaatttttaaattgtttgtagaggtggggtcttgctgtgttgcccaggctggtcatgtaacctgctgtttttcaaacaggtcaggtatgctcctacctgaaggcttttccactaggtggccccttttccttgaatgctcttcccccatacattctttggctgaccccgtcacattttttgagcctttacttaaacgtctttttctcaataagcctactctgaccaccatctttaaaaactgcaaggcctgattctgctttttcttaatctgctgtaattttgtggccatctttatcacctttcaatgcacaatacaatcttcatatgatatttcttgtgttttgtctatctctacctattagtatataaacttttttctttctttctttttttttgtttttgagacagtctcgctctgttgcccaggctggagtgcagtggcacgatctccgctcactgcagcctctgcctcctgggttcaagcaattctctgcctcagcctcttgagtagctgggattacaggcatgcaccaccacgcctggctaatttttgtatttttggtagagacggggtttcaccatgttggccaggctggtcttgaattcctgacctcgtgatccacccgcctcagcctcccaaagtgttgggattacaggcgtgagccactgtgctcggccgcatataaattcttaaaaggggaatgatattgtctgttttattttttgagcatttagaacagtacttggtatactgtatatactcaataaatacattattatgtaactcaataagtttgcaatgtatgagtcatatattactgaaggacagagaaaacaacgcatgtcttctacccacagataattataagcaatcagggagttagacaacagatgcgaattcttatttttttaatcattaagagaatatgtaacagcaagaagtttagccagcactcttctggttgcaagtcatagaaatccactcaaattagtttaagaaaagaagagaaggatttacttgttaacataactgaatagcacaaaaagaaagctagctccaggcgtgctgggtataggggccttacaattgtccttggaacttattgatttctcccttcatctctcaactctgctttcctctgaaagagctttggtaggccgggcgtggtggctcacatctgtaatcccggcattttgggagtccgaggcgggtggatcatgaggtcaggagatcgagaccatcctggctaacacggtgaaaccccgtctctactaaaaatacaaaaaattagccaggcgtggtgatgcatacctgtagtcccagctactcgggaggctgaggcaggagaattgcttgaacctgtgagacggaggttgcagtgagccgagattgtgccactgcactccagcctgggcaacagagcgtgactctgtctcaaaaaaaaaaaaaaaaaatagcttcaatctcaggccggtgctctccttgtggtagtcctggaagcttctgcctcagaatttcacagttgaccgacaaccccgaattcacgctggcctggtgttggttgcattccctgtgatgttctcatttctctggcttgggctacagggcacttgtacaacccccaaaacacttgtactgagagtgggagagtgaacagataaaattaattatagaattgaaccaaacatatctgtgtaagttgatagagtagaatagatgatagtaaagctgaaagaggaggttcaagcctgtaatcccaatattttgggagactgaggcgggaggatcacttgagctaggagtttgagaccagcctgggtaacagcaagactttgtctctaccaaaaattaagaaaattagctaggattggcggtgtgcacacctatagtcccagctacttgacaggctgaggtgggcaggccgctggagcctgggaggtcgaggctgcagcaagccgtgacagcactactgcatgccagcctgggtgacagagccagaccctgtctcagaaaaaaaaaaaaaaaaaaaaaagttaatagaagtatagcactctgacccctagtggttaaattatgcagagaaaaattcaggacttgtccaaagacaacaggaggttgatttatttcacattatgttcctgtatgatctttttatcagtttatttaagagcatcagctttcttcccttttattctccacattgaagtatccatccatttggggcaatttttcctttcacatatatctagtatttctctcgccgccccccgcccccccaattcctctgctgttaccatatttcttcttgggttcatccaacacctgaaaaatcttcctaaaaaactgttcagttggccaggcacagtggttcagggctgtaatcccagcactttgggaggccgaggcgggcggatcacctgaggtcagcagttggagaccagcctggccaacgtggcaaaaccctgtctctactaaaaatacaaaaatgggccaggcgcggtggctcaggcctgtaatcctagcactttgggaggccgaggcaagcggatcacctgaggtcaggaatttgagatcaccctggcccatgtggggaaaccgcgtctctacttaaaaaaaaaaaaaaaaaaataggcgggtgtggtggtgggcgcctgtaatcccaggtactcaggaggctgaggcaggagaatcacttgaacctgggaggtggaggttgtagtgagccgagatcacaccactgcactccaacctgggtgacagagcaagactccatctcaaagaaaaaaaaaaaaaagatagtagaagtatagcactctgacccctagtggttaaattatgcagagaaaattcatcatttgtccaaagacaataggaggttatttcacatcatgttcctatatgatctttttatcagtttattaaagaacatcagcattcttcccttttattctctacattgaagcacccatccatccggggcaatttttcgtttctcatagatctagtatttctctttttgcccccctctattcctctgctgttaccatctttcttcttgggttcatccaacacctgcaaaactttcctgaaaaactgtttagttggccaggcacagtggttcagtcctgtaatcccagcactttgggaggccaaggtaggcggatcacctgaggtcaggagttcgagaccagcctggccaacatggcgaaaccccgtccctactgaaattacaaaaattggctgggcacggtggcatgctcctgtaaaaaaaaaaattaagagcacttaatagtcatacttttcactttgcttatatgtagcttatatatatataaatataaaaatctgttttaactctcattctactaaattcacctaatgttctacatagaaaatttcatgtatattgtttatcatctttcaagagtgaattaagcacatgaatattttctcatgaaaagggatattgattggtacagatgtgtatgtataatggctagttgctcagatcatcaactaaatctaaaacatgtgttccagctgggctggtggctcatgcatgcaatcccagcgctttgggaggttgaggtggaggactgcttgaggccaggagttcaagaccagtctgggcaacatagtgagactctgttgctgcaaaaagagttttaaaattagtcgagcgtggtggcatgcccctgtagtttcagctacttgggaggcagaggtggggggactgcttgagcccaggagttcaagtttccagtgagctctgatggtgccactgttctccagcctgggtgacaaagccagaccctgtctccaaaacataatcttaaaaagcagttcccaattcttaattttaattttatttatttatttttgagagagggtctcattctgctgcctggactggagtgcagcggtgtgatttcggctcactgcaaactggaccttctgagctcaagtgattctcccacctcagcctcccgagtagctggaaccaccatgtccggctacttttttgtttgttttgtagagacagggtctggtcatgttgcccaggctggtctcaaactcttgggctcaagtgaaacaactgcctgtgcctcccaaagtgctaggattacaggcatgagccaccgtgcctggccccagatttttataattttcatattttattctttattgattagtcactgagagggtaagaattgtgtaacttctttcttgtccatattttctcttcaatttttactgtgaaggccaacataaaatatttaaggcaaacagattttttttttttttttgagatggagtctcactgtgtcacccaggctggagtgcagtggcgcgatctcggcttactgcaacctccaccttccaggttcaagcgattctcctgcctcagcctcccgagtacctgggactacaggtgcctgccaccgcgcccggctaagttttgtatttttagtagagacgggatttcaccatcttggccaggctggtcttgaatttgtgacctcgtgatccacctgtctcggccccctaaagtgctgggattacaggcatgagccactgtgcccggtccaggcaaacagattttattccacttttccttgatcactcttttgttttttctctccaatgctttttctctatttgaaattttgcactattgttgctttcttctgaagtattcatatagagttgttaaaacaactgaagtcagactgcctaagctttaggtttcttctctgttaaaagagataacaagataataatagcactcctcatttatagggttacttatgggtggttattggcacacatttataagtgtttgaaaaaatcttagctttactattattttatagatttacttgcatttttaatgttcttggtatacaccaattggtttgtttacttattaccaaatatttataaagcatttagtgttatattgttggctgaaaaaacaggaacaaaataggatggtgtatatttatgaagcttaactctaatttaagaaacaaagcatgatttttttttttctttgagacggagtctcactgtgttgcccaggctggagtgcagtggcgcgatctcagctcactgcaatctccgccttccaggttcaagcgattctcctgcctcagcctcccgagtagttgggactacaggctcatgccaccatgcctggctaattttttgtatttttagtagagacagcgttttaccatgttagccagtatggtcttgatctcctgacctcgtgatccgcccaccttagccttccaaagtgctgggattacagccgtaagccatcgtgcctggccttttttttttttttttaatctttttgagatggagtttcgctcttgttgtccaggctggagtgcaatggtgtaatctccgctcactgcaacctccacctcctgggttcaagagattctcctgcctcagcctcctgagtagctgggattacaggcatatgccaccacacccagctaattttgtatttttagtagagacagggtttcaccatgttggtcagtctggtcttgaactcttggcctcaggcgatccacccgcctcggcttcccaaagtgctaggattacaggcgtgatccactgcacccggacttactggttgcttttcaaaggttgtacagatactataaatatatttaaccaatactctattgaggaggagccggagagggtttccagtcttttgctattgtaagcaatgcttaaaaaaatactctggaacataggtcattgtaagcaatgcttcaaaaaatactctggaacataggtcattgtaagcaatgcttcaaaaaatactctggaacataggtcattatgtatatttctgtaagataaattcctagaggtagggttactgacttcaaaggatttagactaaaggtgcttaaagagagaggtttcacctgttagttagtttttgtagccaaaacttgaaaacatcctttcttcctcttttttcgtacctatcaatcaccaagtcttgctgctgttacctcctcaatttgtttaaatctgtccttccttcccattcctcccagccaacaactcaatttaggcttttactatttcttcatgtctgaaatatcgtcctcaaacccattgtcctgagagaataatctgctcgaacacattcatgttgcctactacatacatccaggattaagtctaatgcctttgaatacacaaggttcaccttgatctagtccctgtgcttccctttctctggtagacttctcccatcaccagcttcactctctttgcttttacactgtggaataattcatcatttcaggcctccttgcttttgctctggctgactctccagcttggaatgccttcatccatttcccttacttcacctttgtgttcctgtgcattcatctttcatagtgattgctattctctactgaaatgaattttttcaaaatagcctgcaattgcaataggcagtactttttttctttctttttagctctagcatctatcacagtgcttgtggtcatggggtacatactcagtaaaatatcttttactgaactcaactagatcttgggggaaaaggggtggagtcattcattcattcattcattcattcaacatatgtttattgagaagctataaacataggcacaaggttatgtgctaggtagtgcgattacaaccaagaagataacccagggcctacttttggtctagtgaaagagatggaattagatgggtatggtggtgtgcacctgtagtcccagctacttgggaggctaaggcatgagaatctcttgaggctaggagggagaggttgcagtgagctgtgatggtaacactgtactccagcctgggtgacagaagaagaccctatctaaaaaaaaaaaaaaaaaaaaaaaaaagtagggcaacataaatacacaattttaatttaggtgggtaaagacaacagtggaccccagggcacagtttagattattttatggatatggataaacagagaaaagggtggtttttttttttttttttaaatctattttagagactgggtctcactgtgttgcccaggctgttttcaaacttctgagctcaagtgatcctcccacatcagcctcttgagtagatggatggcattttaattagatgaaattgtactaggaaaggcatttgcaaaacaaagtaattgccccaaatcactatgaaaccctaagtcaggcataaaactcacgatttctgacccttcttcatggcctattgcctcctattacctttactttttcaagtaaagatattcttctggtaaacacatggtcaaatacagtgtcttgggtaacgaatagtaaagtgagataacatatgtagagaaagcgggtgagaatccgtactccataaaagtattttctttccataggtgtctgctaaactgccatctaagttttccaaaacaaaaaacaaaaacacttgtgtggtgctcaatgatgtatattaagtgaaacctaccaactgacctttatcctttccttcctgtttttttaatattaaagaagagacctcttttcacaaatgattgaggaggctagtaaaatgcagtgaaaagagcaagttctttgggagtcagacagcatcggatccagcccagagcgcagcacgactagtagagtaacttagattaagtccttaaacttccagtgtcctcttttgtaaactgggaataataataataataaataaatagtgaataatatttatgcaaagtacttagcacagtgtctaacacataaaagcttaggagaagttggctattaagcatttctaggaacccgaggactcagggttgttattttagttcttggaatcaaaggaacttgaagcgtagtcattcctaaactaagttaaaccagaactagcgctttcagcaatgatgtaatttgatctcttcgggccaccgtcgctgagcatg

SEQ ID NO: 235 - DNA, 10000 bp, Homo Sapien
ggacccaatatacattatagacatttttatttaacagtggcaaaagataccatttttcttattagcctgtggaagattttctaatacagaccgtatgttaggccacaaaacaagtctcagtacattttgaaaaagcagtatactttattttcatataccacaatggataaaactaaaaatcaatattaagaggaactttggaaattgtaagaatacatggaaattaaacaacatgctcctgagcaaccactggttcaatgaagaaatttagaagaaaattaaaatgtttttgaaatatgacaatgtaaacacaacatacagcacaaatagtgctaagaggggagatgctctgaataaattctttcatccaaaagtagagagatttcaattaaacaacccagtgatccacctgagggaactagaaaactaaaaacaaactgaaccccaaattagtgaaaggaaaaatatagtaaaaataagagcagaaccaaacaactagaaactaaaaaaaaacaaacccaaactcaatgtaatgaaaagttggtttattgaaacaataaataaaattcctaagtgtctagctaggctatactatatatgtgtgtgtatatatatatatacacacacacacacgtatatatatatatgctatactatatatatagtatagatattgtgtatctatacatatataaaaatatatatatagacagaaaaaactgaatgaaacaaaatcagaaactaaaaagaagatattacaacttatatcatagaaatacaactgtatattttggacaataatacactaatgaaaccgtatgttttgaacaagtatacactataattgaacaccatggaaaaagattaattccctgacatatacaactcacacaaaatgagccaggaaagaagggtaaacctgaacagactaataatgagtaaagaaatagaatcagtaataaaaacgaaatctcccaacaaagcaaagtccaggcctagatggtttcactgatgaattctaccaaacttataaggaaaaaggaaaagcattcctcatcaaacaattccaacaaattcagagaagagaatacttcctaactaattttacaatgccaggaataccccaatgctaaaaacatacacgaacacaacaacaataactataacaaaaattagaggtcagtatttctgatgaacacagacacaaaaatcctcaagaaaatgttagcaaaccaaatctaagaacacatcagaaagataattagcaataatcaagtggtatttatcccagggatgcaagaatggttcagcatacatgaatcgataaatgtggtacatcacattaacagaataaagacaaaaccaaataagcatatgaatagatgtaggaaaaagcatttgataaaagttagcatccatttatgataaaagttcccaacgaactacacaaagaaggaatatacctctatataatgtaaccacatgtgacgaactcacacctaacatacagaatggggaaaactgaaagccatttctctaaaaactgaaataagacaccactcagtcaacattttactttatgtcatgtcctagcgagaagaatcaggcaagcaaaaaaaataaaagccatccaaattggaaaagaggaagttaaattgttcctgtttgcagacgacatagtcttatattaggaaaaacacactggggcctttcagagggtagagggtggaaggagaaagaggatcaagaaaaataactaatggtactaggcttgatacctgggtgatgaaataatctgtacgacaaacccccatgacacaagtttacctatgtgacaaacatacagttgtacgtctgaacttagaataaaagttaaaaaaattgttaacataaaaaaagaaaaatctaaactccaccaaaaaaatttaggactattcaataacattgcaggataaaatatcaatatgcaaaaattagtagcatttctatatactagcaataacccagcaggaatgaaaaatcagctatgaaattccctttacaaagctataaaaaattaattactcagtaatacatttaagcaagcagactgatgtttaccagctatatgactgaaaatgtcaggcaatcatattgagcttttgttttttcatctgaagagtaaacataatgcaaggaattattaaagggctaccataggaataaaagagctaatggtataaaacattattagtattattagtattgcatagtatctatgcaatagtgtaagtcagaaactgaaatggcagaaatctacttttaataaccatttacatttaatgtaattattggtatttttgagccatttttgtttttcatatttatactacttttgattgtttttctttttcctgatctatggattccttgaaaatgttttttgattccattttagttgatctgtaaattttttgcgtgactctctgtacagcattgttagtggttgctctgtgttacattacgcatacataccttttcacagcctagtgctgtgcacattttaccctattcagtaaaatatggaaaccttgctttcctgtctttttaactgctccccctttcccactgtttgtaacagaatcatattaaatatatgtctatgtgcatttagtgccacagtaaattttgtcatttttgctttgacataaatttattgtcttccaggtttgcagctcagaaatctgaactgggtctcactgcgttaaatccatgtctcaaggctgagttccttcctggagtctctagaagaaaagctcattatcttgccacattccttggccctcttccatctttaaagctagcaatggccagttgagccatttgaaactcatgcagaaaacgtgagaagaaagatattttgtgtttacctactttgtatttccaatttttgtttttggcttgttgtcattgttgttgttgttgctcattcttgttgttgttgctcattcttgatgttccagaaaaatcctattctattttttcctttatgattagtgaccttcatagaaccattttataagataggtctgttggaaagaaattctcttagatttttttttctgtcttctaagaatgcctgtattttctctttattgatgagtagttatattggacataaacatctggttgacattttttttctttcagcactttgaatattttagctacatcctattggttattctgctctctggtaataacaccactgttactcacattgtgttttccctatagctatggtgtcatttgtttcttgctgctttcaaaacatttcttttagtttttagaaatttgactacagtgttgcttgcatggattttcttgggtatattctggttggcagttgctcatcttcttgcatctgtaggtttatgcccattgcaagtttggagaattttcagccattatgtctttgagttctctctcaatagcatcctcattgttcttcccttctgaagctcagattttatcattatcacattatttgttataacctttcttgttcataacagtatttaaaattttaccctgtgttcgagtatacagtttctattaatccagcctcaagaatactgactctttcctccatcatttcctttctgttagtgatcacaccaaataatattttatttaattttttacactacatatctcagtatcaaaatttctatgtcattatattatatagtttcttttttctgctgggaattttttttccatttaaattgagagtgtacacattgacctcataatggatgtttgtaacacctgcttcagtgagattgaaaatctcaccgttttaatatccagattgtttcaaggttatcatctcttgattatttaactccttgagaattggtcgattgtttctgattttataaagtatgttgagtaattttctattttatcccacacacaggactttctctgtttacagtacacaataagttcaatgaaggaagttttggacattggagggtagaggccttcttgcttaattgagatccactcactggttcagatagcaggggattttgtcccactaacatttttctacttggagcttctgcctggatgatcctttatggctcttacgagataaaactataagtatatttaacatcatagcatacatagtgtgcactgaaggggtcccaaaaaattcctattcacaaagtcttttttagttttcttttgtgcatcatttgctcaaatctcaattgaatttgaggacttcattttcctttcttccctacagtaacaacacagtttaacacctgcttaattagagtctattacagtacccgggtaggcctgctgtcttctgactggggatttatagaaagtggataatacggctgaggtaaaatcaacgactacaggcctggcgaaatggctcatgcctgtaatccaactactttcaagggcagaagtgggagaattccttgacacaaggaatttgagatatgcttgggcaacatagtaagacccagtctttataaaaaaattacaaaaggatcctggctcggtggtttgcacctgtagactcagctatttgggagggtgagctgggagtatagattgagcctgggagagcaaggctactgtgagccatgattacgccactgcactccagcctaagagagagagcaagtcaaagtctgaaaaaacaacaatgaaaaccacccaaaaaacaaaaaagactagggccaccaaaaaggctttctttttcacttgacttcttgctccagggtttacctttttaaagtgcacctcccagtgtctagggagtctacagacttggagtctcttcctttcttgcctcggtatcacaagtggctccatcctatatccttcagcactccttccccatttcccacagagccaagtagaatagtgatttgaacacatataagcaattttaatccctaccctccttgatgctttacaaaattttgggatggatctgttaagcttttgtctcatttgagtcagggatatctcaggcccagctcaaatccttaaaggaactgagatcagagtagaggaatagaagtgataagggagatatgtataaagtgtcttcatgcaagtaaacaagacacatttaatttcaaattcaagcagtgcagacattgctcaaaaccaattgaataaacatttgaattttaggtctccccaaaggtctacaacagtgatggagtatctttaattcttctacctcttgttctctatggaaaaaagcaaatgtaaaggtgtcatttggtaagtttgtttcaattctaccatcagatactcagttttcaaccatttccctatcctactcattaatgaacagcataagggaaattttcatacattttggtcaacataccagctattggtgtgtcctttttacattaactgaagaataataaatagtctttacagatgttacgagattacaaaacaaaaagcatccaaaggatctaaattagggtgtaatgtggatgcctaatggttttctatcagaactctcaccaattgccctgtctgatgagagaaatgagcaggagctctgtcgtggtgaaggactctgctgaagctcccccaggcatttctctactagagttctggctttctcaaaatattctcagaataagcatatattgtccttctctggcccttcagaaagtcaataagcaaaatgccttgagcttcccaataaactcttacaattacctttgcactttcctcatccactcttctttgactggaccacttccacctcttggtagccattgctttgattgtgctttgtttcatgattgtactgataaagccatgttatatctgctgtcacaattctttgatgaaatgcttcaggatctttatccccttatttaaattttcagggaagcttcttctcttgtctgtagctgctctggttgccatagttttggcatccacagagtgaaaaatttgctcaacattaatttttcagttagaatcatgtaagatgaaccaattaaaaaacatgaagggttggctattgtttgtactcttaatcttcattcctcttctatcatggtatcaacaagatacatttgatatgaatactctgtcactgtagacttgaggttcagcaccatttcatcccttcttgaaataacatatctacttgtgaactgctgatttcttcagccattatccacatgaacttttcagaaagcatcagtggtttcaccttctttcatgcaagcttaaccataaattttctctttgttttcactttaattttagaaaaatgtattttgctcttataggggatgttttgaaactcctgtcttatttttcattattccttgaaatagctcctattcagacatcttacagcatatcagtttaggttcattttgatgccaaaaaatgtggaatccttttatggtatttcttaatataacatacattttcatgaactttttaaagacctactacattacaggaaggcctttcaataatataagaattgctacaggtaacattgaattttctagttgattaggcagattaaatttctgtttttctgctgacataaatagtgatgtgggttgagaaggaatataataccagtggtcaaatattctgcagctatgtggaaagtcaaacagttgcaactaagtgtcacatgctttaagggagtcatagagtagctgcttgggcctagcaggtaccctgatgttaacaggatgattgtctctggtttcaccaaacattacttcaaaagagttactggacatgagcagttttgcctaggtagcttacagtagaccttcaagtaggtaaggaaggtcagagagaatgagcagaggtgaatgccagtcagatgtgcctctttgagtgggtagctgaggaagttccagtcctggtgggaggcaggcttctccttgtctcctgagtccaggaagagaacaggtgatgcttccatatatcactcaactcacaccctattcctgaccctctctaatgtcagaaatgagtgagagagatttgtgtttcaggcaagaataaatattgggtatcaacctaccagacaaccaaaacagagattaccaaagagctgaaggagacactgtgactgacttagaatggagtcaaagccaggagcaggactgcagcaggcgcttaggcatctgtacaggagtcaaggacctcagcaatccacctgtcatttaaaatgaatgtaaacataccgtgtaccaagtagaatcttgatttccaccttctataacctgttctctttaatatcaacaatcattaatttcagaccaagaaaccagaatatattgagaaacacatcaatgaaacaatacatttcccagaactaaaggttaattctccatatcgaaagggcccaatgattatccaaaagcccaaatttaacattttcagggctgagtgcaagaagacaattagtggctaacatactccaactcttaataatcacacattataaagcaagctagactctaggtttagatcacatttccatgtaagtccttcagcctgttgcttggagattgctcatataagctggcatagagactaaaggtgtctgtgtttccctgtaacaatcctgaccccgcaatctgagaggtgggaggaggggggcacagggctgtctgctagagaagcacactagacgttgggctggagcccaggactgatctgcccaagcttcgagagcccctgccaggcatgttatgctcccctatgcctcacttctgagtttggactagtggcaatgtctacacagctcccaatgataaccctactgagcataggactggcagagaataataaccagaatatacaaacaaacaactcaaaaacaacaaaatagtccattaaaaagtgaacaagagatagaaatggacatcttttcaaataagacatacaaataatcaacagtatgtgaaaaatactctatatcactaatcatcagagaaataaaaatcaaaaccacactatcaccttaccctattcagaatggctatgattaaaacaaacaaacaaacaaaacagatgttgggatggatgtggagaaaggagagctcttatacaccctgattggaaagtaaatagtataaactctatggaaaacagtatgatttctcaaagaactaaaactcgattactattcaatctagcaatcttactactgtatctatgcagaggaaatgaaatcagtatatgaaaaataaatctgcacttctatgtttattgaaacaccatacacaacagcaaagatatggcatcaacctaagtaaccatcaatggatactaatgggtttgtaggtaaagaaatcgtgatatatacacaatgcaatactactctgcaaaaaaaaaaaaaaaaaaaaagaaggaacgaaatcactccttttgtagcaatacgaatggaactggatgtgacagataatatgctatgtgacaaaggccagatacagaaagtcaagtataacatgttgtcactaataagtaggtgctaaaatgtgtttacatagatatagaggggagaactatagacactgaagccttggaagagtgagtgggtgggagggaattaagagttagacattaattagtaaatgcaatgtttgttattcttgttatggaaaccctaaggccatgatttaaccattatgcaatgtatacatgtaacaaaattatctttgaaccacatatatttataaaaataaagtttaaaaataaattgagggtgaccgggtgcggtggctcacgcctgtaatcacagcactttgggatgccgaggcggatggaacacgaggtcaggagttcgataccagcctgaccaacatggtgaaaccccgtcttaactaaaaatacaaaaattagccaggcatggtggtgcatgcttgtaatcccagctactcaggaggctgaggcaggagaatcgcttgaacctgggaggcggaggttgcagtgagccgatatcttgccactgcagaccagcctgggtgacagaatgagactccatctcaaaataaataaataaataaataaataaataaataaataaataaataaatataattgaaggcaactttaaacatattttttcaaaaaagaaaaagagggagatggagtaggagaaataaaaaagaaggaagaggaggaggaggaggaagaaagagcctgcatttctaattgtcataattaaatttccataagcagatactattttttttaaaaaaaacctaattagaattttacgggtctgataagaaagaaaatgctaaaaaaaaatatggatactcaatgtgttcctattttgtttgaaagcctagaaaaaaacaatatcagagactattctacttagattttttggacaaagaaatcttaagatttttaactcgggagcatttaattcctcacaatttcatgtctgctgttctttcctaaaatcattattgtgaagcagacatgactatatccactagtttttcatgtatgtgatctgcttagtcttcatcctttaggggagccattttgattattcaaaaatttagaagaggaaacttaggctctgagacttaagtagcttcctatgagtccagagttagcaagacatagttcttaaactgcaatctgagagattccaaattctttgcccattcaagtcaggctgcctctgatgaaatccatttaggttttcttaagaatagtaagactcataggcagggacagaactgatcagtgataaaatatgggaaaataggtctagtggcttctggggaatagaggcatagaaccatactcatttccctagaaaacaaaatcggttacttttgaacttgttaaaatttctctcagcttctgggattttctttcattggtattgttttgcttacattcataagctgactagaatatcaagaaatgacctgaaaataattgt

SEQ ID NO: 236 - DNA, 10000 bp, Homo Sapien
ccaccacgcctggctaattttgtatttttagtagagacggggtttcaccatcttggtcaggctggtcttgaactcctgacctcaggtgatccgcccgcctcggcctcccaaagtgctgggattacaggcgtgagccaccgcgcccagcctaatttttgtatttttagtagagatggggttttgccatgttgtccaagctggtcttgaactcctgacctcaggtgacctgcttgcctcggcctgtcaaaatgctgggattacaggcgtgagccaccgtgcctggacaccaatgcatattctttataataaaactataatgccacaatcataagtatagtgcttctctgagttctgtgagtccttctggtgaattattgagcctgtggggattgtgggaacttctgaacataaagccagtcaggcaaagtgtggctgacttggggacgcctgagatttgtgactagtgtctgaaatgaggggagtcttgtggaagactcagacctttacttcagggatctgacactaactctgggtggtcagccccagacttgtatagtgtgtgtggagggatgagagtctgtgctaagctgttacagttaggagagggagagatgaagccaggacgagcaatgcagaaggaaaacaataatatgggacaatgcacaaggtggaggggaaaaatgtagagcaggttccaagatggaagcctggtcacgaagaatggagacaccagccgggtggctcacgcctgtaatcccagcactttgggaggctgaggcaggcagatcaccaggtcgggagttcaagacgaatatggtgaaaccccgtctctactaaaaatacaaaaatgagccaggtgtggtggcgcacacctgtaatcccagctactcaagaggctgagacaggagaatcacttgaacccgggaggcggaggttgcagtgagctgagatcgtgccactgcactccagcctgggcaaccaaacaagactctgcctcaaaaaaaaaaaaaaaaaaaaaaaaaaaaaaaaaaaagaatggagacaccaatgacagaaagacagagttggagggtttgggttgtaagtagggcaaagaggaaagagggcctctcttctttgctgctgctaagtcacgagattgggcactttatcctctgtcccctagttccctacaatggagtccaattcctctgattctgtcatgcatcccttttcagcataagatcatcagtgccagtgcagcggggaccaccatccatatgccagtgctctgtacatttctccataaggaccctgtgcctggagccagctaacagcacatggccccactgctctcccaaccaggaacaagggacgtatttttccaactagattctggcaacctttagttttgacttctccacagacacacgccctcctgcatctcactgctgtctctcaacacatattccagaagtggggaagaggaggcaatttggacactgtcaaacgggagaggtggtgtgtggtgatggatagcagccctggtggcctgtcctgagtctgatggagagccgaggcagggctcccatcacagctcttcagaatcctatgggcctcctgcggagacagaggcacaacaggcaccaagggaaggaggactttccacatccacaagcagtctatgcaaacctacccaaaggccaagggagctgagaggctgaagaaagagacggtggctcacgcctgtaatcccagcactttgggaggccaaggctggcagatcacctgaagtcaggagttcaagaccagcctggccaacatggtgaaactccatctctactaaaaatacaaaagtagccaggtgtggtggtgtgctcctgtagtcccagctactcgggaggcagaagaatcacttgaacccaggaggcagaggtggcagtgagctgagagagtgccaccactacactccaacctgggtgacagagcaagactccatctcaaaaaagaaaaaaaaaaaaaaaaagagggagactgattgatgtatccagtttctcagaaagaaacatttaatagcaacttagaaacagaagccaggcagccgtcagtcagttatccccgagtcccagggctgatatacctgatgcaaaaggtacacatgcctcagtagaaatgtgtggcaccactgaagtcaacccctcagggaaaggcgcagaatgctatgtgaatctacctaagagcaggatttaaggtcacagtagataaagtggcaatcttagaggaggcattccagaacaggggttaaccagaggacaacatggcggatcagcatccaagatggagcagcttcatcctccacgacaatccaggctgggatctctgtgtctgaaacccagtggaactgccccttgtttccgcccttggaacctcttagaaggtgccatccctcttaagagtccatgtggtcccagcttccaaagcaccacataatttagctcttttctttctttttttttttttttgagacacataattgagcttttttcttttttttttcactcttgttgctcaggctggaatgcaatggctccatctcggctcaccacaacctctgcctcctgggttcaagtgattctcctgcctcagcctttctgagtagctgggattacaagcatgtgccaccatgcccggataattttgtgtttttagtagagacgaggtttctccatgttggtcaggctgttttcaaactcccgacctccttcctcggcctcccaaagtgctgggattacaggcctgagccaccgtacccagcctaatttagctctttccatctgcttgatttagccaaggccacttccctgtaactttccacaggtgagatgtttgggagtggggagggccgttgtactgcgtttggcaatgatctaggggagaggagttgtggtgaacaggcctgcttcctaatctctcttgttgccttggatcgccgggcagtgggaagccgctcaactggttagactgttgggttagtcgtggccattccttctcagcttcctctttttctgtcaaccccttcaatgttgggctaccaggccctgcacactccccctagataaccttacccatccacataccagtgcttcccaaatattcatctccatcccagatctcttctgaccacctcctggatgcctccacctacatgtctcattgacatttcaaactgaacacatcgtaagcaaagcacatcatcttcctcccagacatgtccctatcacaggtaatgacactatctacccagtggttcaagcaagaagcatgggcatcatcactggctcctctctccccacccctcttccccaacacccagttcgtggtgattcctccccccacccccacccctgagacagagtctcgctctgtggcccaagctggagtgcagtggtgtgatctcagctcactgcaacctctggctcctaggttcaagcaattctcctgcctcagcctcctgagcagctgggattacagacgtgcaccaccacaccccgctaatttttatatttttagtagagatggagtttcgccatgttagccgggctggtctcgaactcctgaccttgtgatctgcccgcctcagcctcccaaagtgctgggattacaggcgtgagccaccgcacctggccattcatggtgattctatctcctaatagccctggaatccttccacttctcgccatttccactgccactacggtagtccgagctagcactgtttctgcctggagactgtgtagctttctctgtggactcccatgtcctctcctgcctccctcctctcagagtgatttctcaaaaatgcagaccccctcatgtctatctatctgctgtataaacccctccaaatggcttccgttgctcttagaatcaagtccagattcctgttctgttaggccttcgattttgcctgtcctgtttcccagttatattatacttgatgttccagacagactcactcacctttgtttagctctttaccatgtctcttgcctctgaggctttgcaaatattgtttttctagagtgccactcaccttcatgtaacaaactgctactcatccttcaggtctcagctcactccgagaatccttccctgatcccaaaagtctgggccacatcccctgctatgagctccacggcaccctgagcttcccctaaaagtcactggattgaaatcacttgttccaagtctatctccctcatgtgtgtccctcaggaggaggcccttgacaatgttgttccctgagtgacagtatgggcagggctgtttcacagtgttctgtctcattctgtagtcgcaggctgcccctccagcctgaccaggcagagggagctgcacaaagcccttcctgcttgggggaggatggcccaatgtcgcaggcattcctagtgggctgctcacacggaaaggtttcctgaagccccacaagatgccaagacccaggctccactgcagcaggcctccggtctctaccatctggctgtttgccacccccaagtgtccagtgacagaaggtttgtttggtttccaccaccacagggtcttacatacagcaggtgctgggagcacactgctagccaggccccaggatactgaccacccagctgccgtgggagacattccttcaccaggctcaccactgactgatgcccacccctcttctttccagtctttctccattatctatgttctagtttgagcagtgtcccagacacagttcagaacgaagtcccttggtgggctggcctgttggagagcagagggtgccctggcgggaagcctctctaaaacagatggcccctaccaggtggtcccatctggatgctctcactcacactccttttctgtgcttagcccctgcctgctgcctccccagccagtagtgctccttctagcaactgaggatgacagtaatgtgtgcttagttcagtgatgtgtctttttctgtgcaactgaagggccctgttggctgccaggcaaatgttaaactaagcgggaaaaaaaaaaaagaaaagaaaaaatgttaaaccaagcaagaaaagaggccgggcccggtggctcacacctgtaatctcagcactttgggaggccgaggcgggtggatcacaaggtcaagagatggaaaccatcctggccaacatggtgaaaccccgtctctactaaaaatacaaaaatttgccaggcgtggtggcctgcgcctgtagtcccagctacttgggaggctgaggcaggagaattgcttgaacctgagggacggaggttgcagtgagcctagatcgcgccactgcattccaccctgggcagctgagtgagactccatctcaagaaagaaaagagacttactggttctccctgtctttccacttacacagggccagtccccttcatttgacctgataacaagaactcctgactttaactggacaaatgaggtaaaaaggggaaatgcttgagagggtgtacaaagtccaagcacccatgaacccaatccactaattcacttttgtattaagagaaaaaaatgtatgtcaatacttactaattttaacattcatatgtattaatttgttcagcatatatttattgagcacctactaggtgccgggcactgtgctaggtattaggacacggtggggagcaaaaatgggtctcctatccatggaacttacacactaacagggagacagatctttgatcaaagaaacaattcaggccgggcacagtagctcacgcccgtaatcccagcactttgggaggccgaggcgggcagatcaagaggtcaggagttcaagaccatcctgatcaacatggcgaaactgtctctactaaaaatataaaaattatcgcgccactgcactccagcttgggcgacagagactccctctcaaaaataataaaataaaataaaataaataaaaatataaaaattagccagacatggtggcacgtgtctgtagtcccagctactcgggaggctgaggcaggagaattgcttgaacccgggaggtggaggttgtggtgagctgagatcacgctagtgcactacagcctgggcaacagaggtagactccatctctaaacaaaaacagttcacagttcattgattgcaatggtgaaaaataaagtacaacagagacttgggctgaaaagggaggtatgtggtgctactgaaataacctctcacaaaggatttgagcagcgctattgacccagctgaaacccaaaggaaggacttgatcactaggtgtgtatgttgttgtaaattgtttttgcttttagacctcaggtttagagaactaaggtcatcatgaccctgggttcatggcacattgtatcatcaaaggcccacttgggcactttcttattaacctttcatctccatttttccttcccattccctgtttccccatacgtggttaatgatgaacttatgagagaacctgttctgtctggctttctcagagaaagcaggtaggttgggagtttgccaaatgggtatgatgaaaaggtcatagctcaagtgaaggggttttggaaaggctgttactggaagctggataaggagggaagaaaaggagcaatggattggggtaaagtaattattgcactggaggtcctaattactttgaaatctcagagtattgtggataaagaagaaagatggaaggaaagggccaggcatggtggctcatgcctgtcatcccagcactttgggaggccaaggtgggtagatcacttgaggtcaggagtttgagaccatcctggccaacatggtgaaaccccatctctactaaaaatacaaaaactagccaggtatggtggcacatgcctgtaatcccagctacttgggaggctgaggcaggagaatcgcttgaacccaggaggtggaggttgcagtgagctgagatcgcaccactgccctccagtctgggcgacagagtgagactccatctcaaaaagaaaaaaagttggaaggaaacaggacacctgcataaataagtttggagatagagccttatggttggaaacaggacgcctgaataaataagtttggagatagagccgatcctgggtgataaaatccaagtgggatagttagctgaggtggaatgaaggtcactgtagaaaagttcagagtgttggatggtcactgacatggacacaggataacagaaggggctgaagtgaagcacaagacagggaaccagggcctaatacccttaaagaatgagagcgagttaggagtggttgaatagggtaaggtttagttacaagggatggaaaacaccaaaattaatagtgcttaaacaagataggctggcactttggtttatgcctataatcccagcactgtgggagatggaggcaggcagatcacttcaggtcaggagttcaagaacagcctggccaacatggcgaaaccccgtctctactaaaaatacaaaaattagctgggcatggtggcacgtgcctgtaatcccagctactcagaaggctggggtgggaggatcgcttaaacccaggaggcagaggttgcagcaagcggagatcacaccactgtactccagtattccagcccgggagacagagcgagagactctgtctcaatgaaaaacaaaagcaaaaaccaagacacaagttcatttcctacactcaagacattcagtgttatcttgtcctcatggcactcctcagtgttggaagaaccagtctcctttgatctttttttcttttttgagacaggatctggctctgttgcccaggctggagtgcagtggtatgatcacagttcactgcagcctcaaccacctgggctcaagtgatcctcccaccttagcctcccaagtagataagaggaagagccttcctcttatcttgttgctctgcatggtaccaattcccaaagctacttcagtatggctactgaacttccagctgtcgtgtctgcattccaaacaataggaagcaagaatggataaaggggaaaatgtacccttcttgtaagaacacttgcaaattgtatacatcattttctctaccattggccacaatttaatcataactgggagggaagctgggagatgtcatctttattttcagcagccacaaccccagctaaaatactggaacattctatttctttttttttttttttgagacacagtctcactctgtcgcccaggctggagtgcagtggcgcaacgtccgctcactgcaagctccgcctcccgggttcacgccattctcctgcctcagcctcccgagtagctgggactacaggcgcccgccacctcgcctggctaattttttttgtacttttagtagagacggggtttcactgtgttagccaagatggtctcgatctcctgacctcatgatctgcccacctcggcctcccaaagtgctgggattacaggtgtgagccaccacgcccggccctggaacattctatttctttctttctttttctttttttttttttttttgggacagactctgttgcccaggctgaagtgcagtggcgtgatctcggctcactgcaacctccgcctcctgggttcaagcgattcttctgcctcagcctcccgagaagctgggattattggcacacaccaccacacccagctaatttttgtatttttagtagagacggggttcaccatgttggccaggctggtctcaaactcaggtgatctaccagccttggcctcccaaagtgttggaattacaggcatgaaccaccgcacctggcaggaacattgtatttctagagaggaatcaactattgaagaattggcaccttctcccaaaggaagcgctggggaagtcagtagaacacaaagaattggatgaaagggatgtagtagaatggcatgagcctgcaacgggcagggttttctttgaactgggtgaacagtctggcagtggtacgaggaccccgactccccagcctggggaagatgagatatgtgaggttgaggtttgagaagaaaagccaccacttggaggggctgcagaagtggctctcagaggatagctggttttccatgaaggcaaggagggagcagagagctagcctggaaggttcaccagagggcccttgggagtgggtgagtgggaatggagctgggtgggggtcagcaaggacagggttatttggttactggatgaaaacacggatgaaaagccagtggacttggtcttgatagtgtctgaggagggtgggtcttacttggccactgcgacccaaaccagaaactgctcccccttcaaaatccacgagtttacttatcacagccaaccaggttacctcccatgccatcctttgacttttgcatcaagcacttaataaacttaatatctaacccttggtaccagcccccaaattgtatgttcgatactataaatttgaaagacatacatatatcctttccaagggtcaggaaagaacattcaaatgtcaaaaatgatccggaggagtcccatactgctcagggtaggtcgctttgcaaagcaatgagaaaaatctctgaaatagttgttttccccatagccatcatttaacattgtttcattattatcagttttttctcagggtggctactctaccaggagcacacagaagtgctcagcgcccccacccagctctcctagccctcagggatctgggattatagtctccattctcaggcaaactccttttatcaagatgttgaacattctagggagccaactgacttgaggtgtacaacagaacagtcatgaggaagggacctctatccacagtcatgaggaagggacctctatccacagtcctgtgagcaaaggaagcaacagacagctgccagcacaaagtctcaacacactgcctccaggaagtaagactgcaggatggcgggaagcagatgtagtatgggtgcgcccagcccccctcaccatctgtggaccccaggcaatgcag

SEQ ID NO: 237 - DNA, 10000 bp, Homo Sapien
  misc_feature 1, 2, 3, 4, 5, 6, 7, 8, 9, 10, 11, 12, 13, 14, 15, 16, 17,18, 19, 20, 21, 22, 23, 24, 25, 2226, 2227, 2228, 2229,2230, 2231, 2232, 2233, 2234, 2235, 2236, 2237, 2238, 2239,2240, 2241, 2242, 2243, 2244, 2245, 3329, 3330, 3331, 3332: n = A,T,C or G
  misc_feature 3333, 3334, 3335, 3336, 3337, 3338, 3339, 3340, 3341, 3342,3343, 3344, 3345, 3346, 3347, 3348: n = A,T,C or G
nnnnnnnnnnnnnnnnnnnnnnnnnagctgctctggaggctgaggagagagaatcacttgaacccaggaggtggcagttgcagtgagctgagatcgtgccattgcactccagcctgggcaacaagagtgaaactccatctcaaaaaaaaaaaaaaaattagccgggcatggtggcactcgcctgtaatcccagctactcaggagtctgaggcacaagaatcacttgagcccaggaggcggaggttgcagtgagctgagatcgtgccattgcactccagcctgggcaacaagagtgaaactccatctcaaaaaaaaaaaaaaaattagccaggcatggtggcactcccctgtaatcccagaagagacttaattttccaaacaataagccccaataaaaacagcatgaagccaattaaattttttccaaaaaaaaattttttttttgagacggagtcttgctctgttgcctaggctggagtgcagtggtgcgatctctgctcactgcaacctccgcctcctaggttcaagtgattcttctacctcagtctcccgaatagctgggattacaggcatctgccaccatgcccggctaattttttgtattttttagtagaggcagggtttccccatgttggccaggctggtctcgaactcctgacctcgtgatatgcccgactcggcctcccaaagtgctgggattacaggcgtgagccaccacacctggccccaaaaattttataaatagtctataacattttaatcttgaccataagatgtaacttccataacctttgtataacctttataacctttattaaggagtcagttaatgctccaagaaaaccttgtgaatctgacacaggggcccatatgctggtcttgcatcagtgtgtctttgacattaatggttaatttatagagaaactgaatttattttatttctcaaaatcaacccttaccatctcacatgcccacctcttctgcaatagtccctgggccttgaggagtttaacagctttaatttgtggccgtgtgtctcggcaatacagttattttgattggcatcttctactgggcctgaagatgaggctttaattgatgttagtttttaagatttagcagaattggtgtcctttttagacccaagaatcaaagccctgtaactcagtgtcacaaggactttaaaagcacatacagaaaaatacatggatgtaataaacttaattttaaaaaattgtttttggcctggcatggtggctcacacctgtaatcccaacacttttggaggccgaggtgggtggatcacctgaagtcaggggttcaaaaccagcctggccaatatggtgaaaccccatctctgctaaaaatacaaaaattagctgggcgtggtggcaggcgcctgtaatcccagctactttggaggctgaggcaggagaattgcttgaacccgggaggcggaggttgcagtgggccgagatcgggccactgcactccagcctaggtgacagagattccatctcaaaaaaaaaaatgaaaaggaaaaagaaaaaaagcaagagtagcctctgttgcaataactattttagtcaataaatcaggtaacacaatacaaaagtaggcagtttagccaggcaaggtgggcagatcaccgaggtcaggagttcgagaccagcctggccaacagggtgaaaatctgattctactaaaaatacaaaatattagccgcgcatggtggtgcatgcctataatccctgctactcaggaggctgaggcagaagaatcacttgaacccgggaggcagaggttgcagtgagccaggatcacaccactgcacaccagcctgggcacgacagagtgagactccatctcaaaaaaaaaaaaaatttattttgccaaggttgagagcacacacctgtgacacagcttcaggagatcttgatgacatgtgtccaaggtggttagggcacagcttggttggttttatacattttagggagacataagacctcaatcgatataagtaagacgtacattggtttagtctggaaaggcgggacaactcaagcacggagagggcttccaggtcacaggtaggtgagagacaaactgttgcattcttttcagtttctgattagcctttccaaaggaggcaatcagatatgctttttttttttttttgacaaagtctcactctgtcacccaggctggagtgcagtggtgtgatcnnnnnnnnnnnnnnnnnnnnataaaaacagcatgaagccaattagattttttccaaaaaaaaattttttttgtgagacggagtcttgctctgttgcctaggctggagtacagtggtgcgatctctgctcactgcaacctccgcctcctaggttcaagtgattcttctacctcagtctcccgagtagctgggactataggtgcccacgaccacgcccagctaatttttgtatttttagtagagacggggtttcaccatgttgaccaggatggtttcgatctcctgacctcgtgatctgcccgcctcggcctcccaaagtgatgggattacaggcgtgagccactgcgccccggctccagatatgcatttatctcagtgagcagagggatgactttgagtagaatgggaggcagtttgccctaagcagttcccagcttgactttttctttagcttagtgatttgggggccccaagattcattttcctttcacactgtatatcccaaagttctggaagaggatcaggcacataataggtgctcaatagttgatgaattgaaccaaattgaattgaatccttcccacagttcactactcctcttttttttttcttttttttttttctgagacgaagtctgtgttgcccaggctggaatgcagtggcaggatttcggctcactgcaacctctgcctcttgggttcaagcaattgtcttacctcaaccttctaagcagctaggattacaggcatgcgccaccacgtccggctaatttttgtacttttagtagagatagagtttcaccacgttggccaggttggtcttgaactcctgacctcaagtgatctgcctgcctcggcctcccaaagtactgggattacagacatgagccaccgtgcccagccttttatttttttattttttgatactctttctgttgcccaggctggagtgcagtggcatgatcttgattcactacaacctccacctcccgggttcaagcaattctcctgccttagcctcccgagtagctgggattaccggcgtgtgccactgtgtccggctaatttttgctattatttttagtagagatggagtttcaccatgnnnnnnnnnnnnnnnnnnnnaataaaactcccgtttcggctgggcacagtggcttatgcctgtaatcccagcactttgggaggccgaggttggcagatcacgaggtcaggagttcaaggccagcctggccaacatggtgaaaccctgtctctactaaaaatacaaaatattagccgggtgtggtggcgcacgcctgtagtcccagctactcgggaggctgagacaggagaatcgcttgaacccaggagacagaggttgcagtgatcagagaccatgccattacactccagcctgggtgacaaagcgatactccgtctcaaaaaaaaaataaataaataagatttggtttaggagtcatgcagctggaggctgcaagattctgaacctccccaaattgctcctggggataacatcattcttgtaaaacctaagatgagtgcttgtgatattttgcagaccctgcactcaaagcatcatctggcaacacccggatcaataaactggttcatctgttcttgtggcccccacccaggaaccgacccagtgaaagaggagagtttcaactccctgtgatttcgtctcccacctaaccaattagcactccccactttctgaccccctacccaccaaattatcaaaaaccctgatctctgaattttcagggagattgacttgagtaataatcaattttgcatgtggcatggccggcctcgtgtcaattaaactctttctttactgcaatgccgtggtctttatttgtgcagaggacaggaagagcccactgggcagttacatttccactgaggatgctaagctggtggaatatgggcctgcagctgctagtggccatcagtgaggtggcctgagaataaaaccgatacatggcagaggtggagagagacagatttgagtgcctgattctgctggcctgaagtcatgtgtgtgtctggagctttcagttgtgtgagtcaatgagttccctttttgtaagctagtttgagttggatttctgtcacttacaacaaaacaatcccttataaagggagcttctaataaaagaagtgttgagtccagctccctccggtagggccaggacttggaagtccagtagactctttcatggagcacagaacacctgggcctcatttctgtctgcaaagctgttaatgtaggtagcctgcctgtgatgggggataaatcaggaagaagcagtaaggaaaagctggcctgctctgggaatttatacaggttttggcccaggtgaggatacacagagacgatccttcctcaccaccactaggtggagtttgagcacttcgggtgcgcgctcagcagccaaaaggaacccatcagtgtctaggctaccaaggaagaggcaagaaagacacagccccctgccctccaagcctccccgtctttctcgctccctctctatgttaccaccccttctttcagacacctggggacttttacgttccctatgcaactcctctcaaatctgattcatgacattcacatccaggaaaaaatggtaacagcctacaataaatcaagacagcatgatattggtcaaaggctagacacacagatcaagggaacagaagtgagggcacagaaatcgagccacacaaatatagaaaacagattttttacaaaggaccaaaggaagaagaagaaagaagaaggagaaaaagaagaagaaggagaagaagaggaggaagaggaagaagacgacgaaggaggaggaggaggaaagaagaaagaagaaaagagagaggaggatgagaagaaaccaaacccagacctcacataatttacaaaaattaactcaaaatggatcatagacctaaatgtaaaaagtaaaactataaagcttctagaagaaaacataaaagaaaatctaggtgaccttgggcctaattatacatttttgggttttttttgtttgtttgttttgttgttgttgttgttgttgttttttgagacggagtctagctctgttgcccagctggagtgcagtggtgcgatctcggctcgctgcaaactccgcctcctgggttgaagtgattctcctgcttcagcctcccgagtagctgggattacaggtgcccgccaccacacccagctaatttttgtatttttagtagaaatggggtttcaccaggttgaccaggctggtctcgaactcctggccttaggtgatccacccacctcggcctcccaaagtgctgggattacaagcatgagccactgcatccggcctcaatttttttttttttttttgagacagagtctcactctgtcgcccaggctggagtgcagtgacgcgatctcggctcactgcaagctccgcctcctgggttcatgccattttcctgcctcagcctccctagtagctgggactacaggcacctgccaccacgcctggctaattttttgtatttttagtagagatggggtttcattgtgttagccaggatggtctcgacctcatgacctggtgatccgccctcctcggcctcccaaagtgctgagattacaggcatgagccaccacacccggccaatttttgtattttttttttttagtagagatgagggttcaccatgttgggcaggatggtctcgatctctcgacctcatgatccgctgacctcagcctcccaaagtgctgggattacaggcctgagccaccatgcccagccctgatatatatatatatagatagatagatagatagatagatagatagatagatagatagatgtaattttgagacagagtttaactcttgttgcccaggctggagtgcaatggcgcaatgtcctgctcactgcaacctccacttccggggttcaagtgattctcctgcctcagcctcccgagtagctgggattacaggcatgcgccaccacccccagctaattttgtattttttttagtagagaagaagtttccccatgttggtcaggctggtttcacacccccaacctcaggtgatctgcctgccttggcctcccaaagtgctgggattacaggtgtgagccaccacgcccagactcctgatattttttttattttattttttttgactcctgatatttttaattaaaaaaaaaattaggaggtcagggaacccaatatggaaggcagattgtggcaaaagaatttaatgatactactaatgtatgaaataacttttctgaagggagctgggggaaaggtgctgacctgagtaattttggaaatgagtcgagtctgtaagatcaaaggcaaatggaactacacataagcactgtaccctagtttataagattgttctccacaggggtatgtgttaacaattctcttttgagacattatgattacaaataaagaaatattttattttattttattgaaacggaatcttgctctgtaacctaggctggagtgcaacgacgcgatcttggctcacagcaacctccgcctcccaggttcaagtaattctcgtgcctcagcctcccaagtagctgggactacaggtgcgtgccaccacgcccagctaatttctgtatttttagtagagacggggttttgccatgctgcccaggatcgtcttgaactcctgacctcaggtgatccacctgcctcagcctcccgaactgctgggattacaggcatgagctacttgcctggcacatataaagaaaaattttaggctgggtgtggtggctcacccctgtaatcctagcactttgggaggccgaggcaggtggatcacctgaggtcgggagttcgcaaaccagcctgaccaacatggagaaaccctgtttctactaaaaatacaaaattagccaggcgtggtggcgcatgcctgtaatctcagctacttgggaggctgaagcaggagaatcgcttgaacccgggaggcagaggttgcagtatgccaagatcatgccattgtgctccagcctgggcgacaacagcaaaactccatctcaaaaaaaaaaagaaagaaagaagaaaaagtttaggccgggtgcagtggctcatgcctgtaataccagcactttgggaggccaaggcgggaggatcacctgaggtcaggagttcgagaccagcctggctaacatggtgaaaccctgtttctactaaaaatacaaaaacaaattagccaggtgtggtggttcgtgcttgtaattccagctactcaggaggctgaggcaggagaatcgcttgaacctgagaggtgaaggttgcagtgaactgagattgcaacattgcactctagcatgggcaacaagaacaaaactccgtctcaaataataataataataataataataaagaatttaaaaagaaaaacaaaacaattctgatactcctatacacgtgtcctggaataaacaattaagtaaatagatggcaaattatggaagccaggtttctcacagttggggtgggagtttagataaacaagggaggtggctagaatgatccatgtagtaatggattaaagttggagacatcagtatgaattcatgcttagcttaatatagatatggatggttatatatggaaatacatgtttgtgtatatacgtgggttagtatacacacatatatttccttgctttctcagatgtgagggtccagaagcaatgatacctcaaaagcaacaagcacacctagggcccagatcttggattctaaaaccatttgccaataaaagaaaataggggtccttggagaaatggctgattgcaggactgtggcaggaaatacacaaaatgagcctggagcattttatagtaccagaaagtaaggtgacactaaataaaaacaaggttttaattaaaataccaatgatgacaacaacactgatgggactcttatttttctccctggttgaggattgaccgccatcatgaatgacttagtaactatctgaactaggaagttcatgatcaactgactacatacttcaggaggaacaaatggttattgaggtccttcaccctgggaagacaacagtacctaagacagaaattcaggaaaaactagccaaaatgtatgagactacactagatgtcatcatctttgtttgtttttgtttgtctttatgagatggagtctccgtctgtcacccaggctggagtgtagtggcgcaatctcggctcactgcaacctctgcctcctgggttcaagtgattctcctgcctcagcctcccgagtagctgggattacaggtgcctgccaccacacccggctaatttttgtagttttagcagagacagggtttcacaatgttggccaggctggtctcaaactcctgacctcatgtgatctgcctgcctctgcctcccaaagtgctgggattacaggcgtgagccaccacgcctggcctcatctttgtatttggattcagaactcattttggtggtggcaagacaactggctttggcatgatttatgattcactggattatgcaaagaaaaataaacccaaatgctgacttccaagacatggcctggatgagaagaaaagaactcaagaaagcaatgaaaggaacacaagaccagaatgaagaaagggggactgcaaaggacagtgttggtgtggcaaaaagccaaaggagtaaagatgctacagtaacatctgtggccactgtggatttttcacaagatttataaactaaaaacttttgtgtgcaaaaaaaaatggatgggggtatgctaaagagacacaggagccaacggaaacagctctcaaaggccaaagctagaacgaaattagctagaaaataaatatgaagtatattggattataacccaaagtataaatgtccatgagtccatactgattaaataaatggttgaataaataatggaggagtagagacaaatatctcatatgaaagaactccaggccagggatggtggctcacgcctgtaatcccagcactttgggaggctgaggcgggtggatcacgaggtcaggagatcgagaccatcctggctaacacggtggtctctattaaaaatacaaaaaataagccgggcgtggtggcgggcacctgtagtcccagctacttgggaggctgaggcaggagaatggcgtgaacccgggaggcggagctctcagtgagctaagatcgcgccactgcactccagcctgggcgacagagcgagactccgtctcaaaaaaaataaaaaataaaaataaagagcctaaggactaaggatttaattaaccaagcaccaacccgtgcagcctcaggagactggtcccgcagcgcaagtgtgtccctctaccccccgcaagccgggccgcgtcttcctggctctcctggcgccggcaccgagcagggcgtggacctgaacttatgtgaccccacccggtcacaacccggggtaggaagctaaagccgtccgcccacccgaggggcggtcccagcaccccagtgggggactgctgcgctcggcctctgtgttcgatcgggaacccaggtctcttccctgccaataacaaaaccgccgcgtcccgggcctcccttccggagccggagtcggcggccgagcgctggtggcggagcctggacagttaattccaaccgcctccgggtgattccggggacaggagcgccgagagctcctccctttggccgcggagccggctcggcgctgattgg

SEQ ID NO: 238 - DNA, 10000 bp, Homo Sapien
ttgagtaggtgcaagtaggtaggatctactccacaaagggaggagataacctgagacaagaataaggacagatcattcatagaaacaagagggaagaggatgtgcaagggtgcaggtagatgggtagctctgttggtagaaacaggtagaagtcctcttctgattgcttctcttttttctttgaaagaagagggtaagctcattacctgagagtgtgattgagtggagaggtggtagaggtttgagaagaaagcagaaagggtgaaaaaattatctgaacagtgaatgtacccctatttgtcacatgtgcgcatatttccagtaataaattccttttaaaacacctttaatattgccccactgccttcaggataaacgtaaattcattagcatcatgcaatcttcttgatttatctccttcataaactttaacctcatctcctaatgcattctcattatgacctatgttccatttttatcaattacttagcatattccccaaatggctttatgtttaatgctcctgtggcagactgtattttccaaagatgactgccaataatatatcccatcccatgtgttgctctgtaatgtgaccttaaaagcagtctacctctccagtcccttgaatctgtgactactatgaccaacagaatacagtggatatacccctgtgccagttctgggagtagcccttgactggcctggcagtctctacttatgtcttttggaatgcttgctcttgggatacatcctcttggaacctaaccaccatgctgtgagaagaaaaaggtacaagaggcatttctgacaggcagccctagctgagcttccagtcaaaagccagtgtcagatgttagccatgtgaatgagtcatcacggaatgaccagctcacttgaatcttcagtatacctgattgcaaccagagaccccaatcaagaaccatccaggtgaaccaacccagttaatccacagaattataagagtttgttgttttaagctcctaaattatagggtgatttgctatgcagcaaaagacaagcagaagtgttttgagtgtgatgtggtagatggaagttgtattatcatttactgaaggcatggtaaatagatgatctaggatcaagtcatggctctgccactacctggctatattaccttagaagttatttgaattcctgaatttcattcttccatatatggggataataataactacctcacctgacacagtccctggctttaaaggagtaaatgtttctgcccttcaccttaggccttacttttggcccactaaggaaagaactttctctcctatcattctgacgttttctctttatacccacatactagctccttcttttgagaactgctacaacttgttgagccacattttactactgggcatagttattgcatgtgtacctgtgagcatgccttctgtttttcctgtaactgggtacatgaggacgttccagttaccctgccaacgcagctacttgataagtacactgagagcctgcccccagagactgaggttatatctaagatatagatatggagatagaggaagctacttcagccttgggacaaagtagtattctgcaaccaagctttaacaaagcactgggtacttatagaaagtggcattttatttcccatatggccactattcctttttgttcatggctccccaattgaggaagagtataaatgtagcaggacgagccacagacaaaacccctcagacaccaagttaaagaaggtaaggctttattcggccgggagcatcagcaagactcacatctcaaaaaaatgagctccccgagtaagcaattcctgtccctcttaagggtttagaactctaagggggtctgcatgagagggttgagattgattgagcaagcagggggtacgtgactgggggctccatgcaccagtaattagaacagaacagaacaggacagggattttcacagtgcttttccatacaatgtctgtaatctatagataacataaccgattaggttgggggtcaatctttaactaccaggcccagggtgtggtgctgggctgtctgcctgtggatttcatttctgccttttagtttttatttcttctttctctggaggcagaaattgggcataagacaatatgaggggtggtctcctcccttataaatgcccaccctgataatcctaataaagtcctcctgttctttagcattcagttcaaacaatgcctgttctggaaagcctgtctttattaactcacccgaattctgttaggtttcccttccctaagttttcatttatccttacatagaacttatatgacttctcatatccataatctgatttgatactttctcccaatagtcaatgaacctctttagaacagggaaaacaaaggtcttccatttaaagtgttgacatatggcagggtcatatcttgcatacattacaaattttaaggatatatgagtgtgtaggtacacagcatcctccacaccaaacacacattcttccaacaacaatagctaaaacctagatacggattttaaacatatcccaaacctagaagttaagatataaagagtgtaacttgaggtgaatagaaaactggtgatatttatttaataaagaaataatatattgatgtcatgtaacaaagtttttgctaattaatgaacattttgaacttgaaaggtagaaaaataattaaatagtaataggtttgatattctgaagtatcagttttaaagcctctatcataaactatcattaatgtggccaaaaagcaatactgaaatgttggtactattattcaatatatggaatttaatgcaccatagatatcctggtaaaatgaacaataattatacaggagtcacaaatataagtatttacttatataccttcattgtcagtattgagtttggcttccagttccgtaatcttgtgtcttagttcaaatattgagagttgcactgcatccctgttatttaaaatatttttgttgattataattcaattaaaaataacatcagaaaaataatacatagtaacccactactacttcaggaacaatttactatgacacattatttactgaaggactggttaagaaataagactcaggcaaaggaaggcttccaattagtcagttctaggactcaaatatgcactaaagctcaaagacccccaggcaaccattagaaatcttttatttatttttatttatttttttgagacagaatctcgctctgtcgcccaggctggagtgcagtggtgcaaactcggctcactgcaacctccgcctcccgggttcaagcaattctcctgcctcagcctcctgaatagctgggattacaggcatgcgccaccaagccctgctaatttttttgtatttttagaagagacagggtttcaccatattggccaggctggtctcgaactcctaaccttgtgatccgcccagcctcggcctcccaaagtgctgggattacaggcgtgagccaccaggcccggcccttggaaatcctttatttttaacttaaatatcatcctaaagaagttagttacctggtttttcagaaccaagcaaattaggcactgcacattattacagaaaggcatacctagggcaatacataacagctgacaaactgaaacaaagagaaaaaaacaaacactaatttaaaaggttagctatttagggcatcagtaaatagaacattatcatatgacagggccatttattcaataaatatttttgagtgcctattatgttcaaggcattgtattaaatacggaagaattcagtgaacagtgaacagaaaaatagcaatagcggcagcaaagttccactggatgcgtatcacaagccaatgctaagttctttatagtgcatttcattccaacctgggaacaacagcaggaggtatgagatgactatttgtataccagtcttagagctgagaaaactgaggattaaagaggttaattaacttgtctaagattgcatagttactgagtgacaagagatggagtttgtgtttttgcaggactgtcctcaagtacttgctcttattctctacttcctcagaatacacagaacctgtcctcagaacgcgtgtagtttggtagcaaaacaagaaatagacaggcaattaaaatactgtgactggagctacaatagaggaaaacccagaaccctatctaggcacaaaggagagtccaattctcacgggacttgtggatggagttgggagtatgtccaaaaaatactttaaatgtttcaaaaatttaacacgaagtacgaatactgtttttaaaaagcataaaggaggagtaacagttttactaaatgtcattttatgaagttccccttaaagggatgaaagaaaaaaaaaaccccgtataactaaataaaatctttggaattttaagcagaaaacctggatttatggagacatcaaaaccaaacacaacttttggcattacagtatatgggcaaaatacacgccatatgattggatccttaagggcagcacatcctacccggaaagctgcctacttaacaataccaaaggcttactcaaagaggcacgtgaatctttcgcatggaatacttttggaacccagaccgaagtgcccaggggttaatcacggcgccggtcttacagcaccctcagcggcttcagccctgagactctgcaggtgaaggctcggggggtgtggacgggaccccacaccgcgccgcccgccgactcacttcttgcggacttcttccagcaactgctgtttcaggcggttggtgctcacaccgtcgaagttgtagtttctctcttccttcatagtgtcaggccagagacctcccgcgtctttcccctcagcaccttagagcacaagacattaagggccacccagaagccagtacggcacgaggcggtgaaccccaaccgccccccggtcgcacctcccgcgcctgcccgcagaggcacgtggtgacgtcataaagcgatgcccgcaggcggcagggggtggggcgagggcagccggggagactggagaagcctactctgtgcggtggagcgaccctggataacagctccagggacactccttgctcaagacgctggggttagacgtgctccggctacacagcggagtgtcagggggccaagaatatccctctcctttttcttccctcctgctggctttggttgctttcctaaacattgccccaggcggcaaagtcggcttcactcttagcccttgttagggaaacgctggatccaagattagctgcgcccttctttgcttcagttgaacaagcaccagagtcgctgatttggcagtgtcggagcgggaggaactggtcttaaaaaggtacctcctgaactcgggaagactgctaaccctccagattattgttttgcatctgtgtgctgttcatgaacatacctcagagctgctcactgcaacttgaaatttcattatatttttaatcacaaagtttgcatcctacccttgatacatctgtgtttccttgacaaaaagagacaaactctgtaaaatatttgaagagatttattctgagccaaatgagtgaccaatggctggtgacagccctcaggagattctgagaacacgtgcccaaggtggtcagggtacagcttagttctatacattttagggagacatgggacatcaatcaaatgcatgttaagatatacactggttccatcgggaaaggcagggcaattggaaggggtgggggacggggtggcttccaggtcacagctagattcaaagattttctgattggcaattggttgaaaagttactgactaaagacttaggaatgtctttagagaataaaggggttgtggagaccaaggttttagtgagaatgggataattggtgtggaaaacacaatttggtgtcagaagtgttgtgaatacatagttttccaattgagtttctggatgagattaacatttcaattggtagactgagtatagtacattgtcttccccaatgtgggtgggcctcagccaatcgaccgaagacagaatagaacaaaaaggctgacctcccaggagtaagagggagctcctacagccaaacagcttgagctggaacacttttccagccttgggctcagactgggactgcacatcagtttgcttgcatctacagcttgtcaactgcagatcctgagacttctcagccttcataattgtacgggcaaattccttataataaatcttttatacacacactccctattggttctgtttctgtgaattaccctaatataggaggtatgcttatcaaaattttgtctagctgttaagtctgaaagggcaactcacaaccaagtaaacagaatagaatgaagtgaaaaggactagattatctgttgacaaatccaaatatacagaggatttcttttttgagacggagtctcatctgtctcccaggctggagtgcagtggcacaatctcagtttactgcaaactccactcctgtgttaaagcaattctcctgcctcagcctcccaaagtagctgggactacaggcacgcaccaccatgcctggcttaatttttttgtgtatttttagtagagatggggtttcaccatattgctcaggctggtcttgaactcctgacctcgtgatccacccacctctgcctcccaaagtgctgggattataggcatgagccactgcacccgacccagaggatttcttaaaaagatctgttagcaggatctcactgtgggaaattaggagcaaaggcaagcagaaaacaggtttgtcaacaactacagaaaccacagatttgtgtttctggcagagataaaggacctgaatttaccctcctgcctgaaacaactaaaaaactaagaggaacaaaaaaagaacattgaacatcaggcaataagggaaaacgatcaccaagagatgagacacaaatgaggcaagctcccaaattggcctgggcctgccagggtacaaagcagaaagggagaaaacaggcagaggctggtggttgccctaagttgaggaaacggagtttctctaagagtctagagagaacaaggcagctagactttgcagggcagatattggaggggagagctgcacagggtgttcccagaccaaactgagggttgggttgctatttcttgtgacccagtaagaacatgtagatgaactggggaggaagagagtttttatttctggaaccagttacaggcagaagccctggaaactataaccagaccaactcaaaattacagttttccagaccttctaagctatatgtctatgtgtaagtgtgcattcatctatagacattaagtggttaactttttataatctacaactaaggtcttgagtcctgaagaccttcctctggagcctcagtaaacttaatctaaatgggtccaggtgctagggtgattacccctgtctcctgctaaatcagggaggtttggggattccttcagaaccccaaaaaacttgtttaatcctaaatgagtccagctaagaattccttctttttttttttttttttttttgtcatgctttgagacctagttcttggtgggtttttattacattccagcctttgtataagggctttggtttttttagcttttagtatttaacttagccactcaagtcagtactgaaacagttgttatggaggcctgtgttaatgagacctggcctgccacaaggtacactctgcagcagaatactgatgaatgcacacacatggtggggcaagtactcaggctggggaaagaaccatcacaaaggattagaggggaaatccttacagtttacagaggtaggaataatacctgctaccacccaccagaatggaaaacctctgaattcacagggcatcaggtacacaaaggattttgatttaggagtcggaaaaaacactagccctaacaagttgaaaagaaagatccaaaagtatccaactggttctaagtaacttaatcccctcccaagacaaaactcgagaatatttataggaacacaaaacatccagtacccaataaggtaaaattcacaatgtccaacaatatctttagtctcgttatgttgcccaggctggtctcaaactcctcgactcgagagatccacccaacctcagcctcccaaagtgttgggattacaggtgtgcacctctgcacccaaggtaacattattttcttagggtatgttagaactcacctgtaagtccatctggggctgatgtttctttgtgggaagattttaaactccttatggaacttgtttaatcagccaaaatactcctaaagaatttggttgagggaattgagcctcttgccctaacaatcagtagggcttactaatttacaatgatgacagtgtgggactggcacaggaacaaaagaaatgacagatggaacaaacgtctgagcccagaaacactcatactcgatatatagagaaagacctgtgggaaattactgaagaaaagaactattcaataaatgggggttaaataactgattatctacggggtgggggaggaggggaggaattagataccttacctcttgcacacatatacacaattctcagtaaacacctaaacatgagaagcaaaattgtcagcagtgacaacacgcaaattttacagcacaggcaaatgaatggcaaatgaacatgaaaaattactgatctaaggtcaggaaaggaggtcaagaaaacacaaattaaaattatgagatacttttttatatatgctacattaacaataaaaacattgcaaagggaagtaatactcaagagaatatcatcattttggaaaatacctggcattattttgcaaaacttgacaagccaacaactccactcttacgcataaagtctcttgcatatgtgtaccaggggacagtcaaggatgttttgagtgtactgtttctaccaacaaaaactaaaaacaaatgtcaactgataggaaaatgaacacttaaattgtggtatactcacacagaatactatagagcaagtaaaccatccatgcatataagcgcaagaatgaattttaaacataaactcaaaaaagcaagttgagtaagacttcacattcagacactatatgtagaaagcttcaaaaaatgaaacagtatgtttggagaacatacatgtgtgattaaaaaatggcaaggaacaataaaaaatgacatggggaaagaggtaagaaaataggaagaacatacatataggtaattggcagctttccatgtctttaggtgtgatgagtttttaagtgttgttattcatcataccttacaagtaatatataattttatgtatcaatcattacacaatataaaaaaaatctttagaagatgcctatctcctaatgagtcagtgaatggtgggaaaagtccattttctatagactaaggcagcacactttttctgcaaagggccagagagtgaataagttaggcttgtggaccatatactctctgatgcaactattcaactctcacgttgaactagacagcagccatagccaatatgtaaacaaatgggtacagctatgctccaataaaacgttatttatgaaaacaggtggacatctggatttagcccatggaggatatttgctgacctctggtcaaagctaactgtttaaagtttatgttccattatttgccattccatttctttttaaatttttatgggtacatggtaggtgtatatatttatgggatacatgagatattttgatacaggtatgcgatttataataattacatcagggtgtatctactgcttcaagcattcatttgtgttacaaacgtcccaattacactcttttatttttaaatgtataaagttattgttgactgtagtcaccctgttgggctatcaaatactacaacaaattcgttctaactatattttcgtacccattaatcaacc

SEQ ID NO: 239 - DNA, 10000 bp, Homo Sapien
gtatctttataataaaccattaaatgtaagtgaagtaacttcttgagttctgtgagccattctaacaaattattgaacctgaggaaaggttcatgggaatttgtgatttatagaaggttaattaatcaagtcacaagtacaagtggcaacctgggacttgtgactggcatcagaagtggtggcagtgttgtgggactgagccctttaacttgtgagatctgatgattactccaggtagacagtgtcagaattgaattaaatgtaggatgctcagatggtgcccagagaactggagaattgctaggaatggaaaaatcccacatatttgggggttagaagtgttgtatgagtacagaaaaacagtttttttcttttaggatagaaggagatgacaaaatatttgggagccaaggatttgtggagctgttgcaggcagatgcagaaggtcctgaccttcctaataggcctaatctggtaattttttttggaggcccttggtgggctgttcctccatcacatgggacatatgcaacctgggggagggcggtatacgttttttccccacaaggccataacctaccatataactgcttgattctgtcacaggaagcttatctcctttcctttcctttcctttccccttccttccttccttccttccttccttccttccttccttccttccttccttccttcctaccttccttccttcctccctccctccctgcctcccttccttccctccttccttccttccatcacactgggtgtacgtaacctgggggatgcctatatataatattatttccctaaaaggccatctcctaccacttgaccacttgattctgtcacaggaaactcttctttttctttctattctctttctttctttcctttctctctctctctcctccttccttcctttccctctttctttcctcctactcccctccccccaccccttccccttcctcctcctcctcctcctcttcctccctcacaaccccatatccctctcccttcccctccctcttctcttttttctttcttcttctgtcctcttcctctgcttttcttttttttgttgttgtgcagctaggtatcatgaaaaccctcatagttctaataaaaattggagcaaagttcacaaagtgtggtccatgtgttagcaatgcatggtcccaggtatcacccacaaagattctaacaggggagttctacgtgcattaaaatttgataatcagggtcgcttccaagatggctgaatagaaatagctctggtctacagctcccagcgagactgacacagaacacaggtgatttctgcatttccagctggggtaaattgttcatgtcattgggactggttggacagtgggtgcagcccatggagggtgagccgaagcagggcagggcgtcgcctcacctgggaagtgcaaggggtcaggggatctccctttcctagccaaggaaagctgtgagtgactgtatttggaggaatggtacacttctgcccaaatactgtacttttcccacagtctttgcaaatggcagacccggagattccctcccgtggctggctcggtgggtcccatgcccacagaacctttctcgctgctagtgtagcagtatgagatcaacctgagacgctggagcttggtggggggaggggcttccgccattgatgaggcttgagtaggcagttctatggtcacagtgcaaacaaagcggcagggaagctcaaactgggtggagcccaccgcagctcagcaaggcctctatagattccacttctgggggcagggcacatctgaacaaaaggcagcagacagcttctgcagacttaaatgtccctgcctgccagcactgaagagagcagtggctttcccagcacggcatttgagctctgataacaaacagactgcctcctcaagtgggtccctgacccctgtgtagcctaactgggagacacctcccagtaggggccgacagacacctcatacaggtgggtgctcctctgggatgaagcttccagaggaaggatcaggcagcaatatttgctgttctgtagcctccgctgatgatacccaggcaagcagggtctggagtggacctccagcaaactccaacagaccttcagctgagggggtctgttagaaggaaaactaacaaacagaaaggaatagcatcaacgtcaacaaaaaggacatccaccccaaaaccccatccgtaggtcaccaacatcaaagaccaaaggtagataaaaccacaaagatggggagaaaccagagcagaaaggctgaaaattccaaaaaccagaacatgtcttctcctccaaaggaacacaactcctctccagcaagggaacaaaactggatggagaatgagtttgatgagttgagagaagtaggcttcagaaggttggtattaataaacttctctgagctaagaagcatgttctaatccattgcaaggaagctaaaaaccttgaaaaaaggttagacaaatggctaactagaatagccagtgtagagaagagcttaaatgacctgatggagctgaaaaccacagtatgagaactttgtggagaatacacaagcttcaatagctgattcgatcaagtggaagaaaggatatcagtgattgaagatcaaattaatgaaataaagcatgaagacaagaatagagaaaaaagagtgaaaagaaaggaatgaagcctccaagaaatatgggactatgtgaaaagaccacatctacatttgattggtgtacctgaaagtgacggggagaatggaaccaagttagaaaacactcttcaggatattatccaggagaacttccccaacctagcaaggcaggccaacattcaaattcagaaaatacagagaacaccataaagatactccttgagaagagcaaccccaagacatataattgtcagattcaccaaggctgaaatgaaggagaaaatgttaaggacagccagagagaaaggtcgggttacccacaaagggaagcccatcagactaacagcagatgtcttggcagaaaccctacaagccagaagagagtgggggccaatattcaacattcttttcttttcttttttttttttttttgagatggagtcttgcactgtcacccaggctggagtgcagcggcatgatcttggctcactgcaagctccgccttccgggttcatgccattctcctgcttcagcctcccgagtactgggtctacaggcacctgccaccacgcctggctcattttttgtatttttagtagagatggggtttcaccgtggtagccaggatgggctagatctcctgacctcatgatccatctgcctcagcctcccaaagtgctgggattacaggcgtgagccaccacgtccggctcaacattcttaaagcaaagaattttcaacccagaatttcatatccagccaaactaagcttcacaggtgaaggagaaataaaatcctttacagacaagcaaatgctaagagattttgtcaccaccaagccttccttaccagagctcccgaaggaatcactaaacatggaaaggaacaactggtaccagcaactgcaaaaacatgccagatttaaagatcatcgacgctatgaagaaactgcatcaattaataggcaaaataaccagctagcatcataatggcaggatcaaattcacatataataatattaaccttaaatgtaaatgggctaaatgccccaattaacagacacagactggcaaattggataaagagtcaagacccattggtgtgctgtattcaggagatccatctcatgtgcaaagacacacataggctcaaaataaagcgatggaagaagatctaccaagcaaatgggaagcaaaaaaaaaaaaaaaaaaaaaaaaagcaagggttgcaatcctggtctctggtaaaacagactttaaaccaacaaagatcaaaagagacaaagaaggccattacataatgataaagggatcaattcaacaagaagagctaactatcctaaatatatatgcacccaatacaggagcacccagattcataaagcaagttcttagagaactacaaagagacttagactaccacacaataataatgggagactttaacaccccactgtcaatattagacagatcaatgagacagaaaattaacaaggatatccaggacttgacgtcagctctggaccaaggtaatatccagaatctacaaagatcttaaacaaatttacaagaaaaaaacaacctcgtcaaaaagtgggcaaaggatatgaacagacacttctccaaagaagacatttatgcagccaacagacatatgtaaaaatgctcgtcattactggtcatcaaagaaatgcaaatcaaaaccacaatgagataccatctcacaccagttagaatggtgaccattaaaaagtcaagaaacaacaggtgctggagaggatgtggagaaacaggaaaacttttacattgttggtgggagttcaaattagttcaaccattgtggaagacagtgtggtgattcctcaaggatctagaactagaaataccatttgacccagcaatcccattactgggtatatacccaaaggattataaatcatgctactataaagacacatgcacatgtatatttattgtggcactatttataatagcaaagacttggaaccaacccaaatgtccatcaatgatagactgaattaagaaaatgtggcacatatacaccatggaatactatgcagccataaaacaggatgagttcatgtcctttgaaggaacatagatgaagctggaaactatcattctcagcaaaatatcacacaaggacagaaaaccaaacactgcatgttctcactcataagtgggagttgaacaatgaaaacacatggacacagggaggggaacatcccacacccaggcctgttgaggggtgggggactgggggagagatagcattaggagaaatacctaatgtaaatcatgaattgatgggtgcagcacacgaacatggcacatgtatacctatgtaacaaacctgcacgttgtgcacatgtaccctagaacttaaagtatgattaaaaatttttaaaaaaattgataaccgatggactacagggaatggttccagaggctgccggtataaagaatcagaaataaaagaacctttgcctctgccaagagactgaagggtagtggtgatgttttgaaacaatatttttttaaactatattattttcttttgtcctgtgattcttttttgttatctaatataagaatttgtgcatgttttaattgctgtcctttggacatcttctggagatgctggtggcccctaaagaagggaggtatttccgggttttctgaaagttgtcagttaactctcttctccagtcctgtaagatctggagtctccaaggcctcccacctgcagcccatacctgtcttgaccatggtaggctgcacatcatagccttggctgcttaggtctgaggctagtcttgctcctcccaagtcagggttcttaaattcccagcagtgagcctaggcttgtgtgtctctctgtcacagtctttcccttactccctctatgctggcacaggttatgtttgagagttttcccccagtttctttgctaattgctttcatttcccatcagaatacaggcccaccctaagcttcagtcaccttggctgcgtccctgacatctatcctggctcctgcagatcctttcaaccagaggcctagattctctttcttgcacctctagccacagactatggtcttattgcaaattgactgattatgaggatctatatgaattcgaatgctccctttctgactttgagttttgcttgccttctggaaagaaatccactaaaacttggtaccatgagccaggcacgtctatatgtgtgttacccctgcctccaattagctcctcaataacccaaagaggaaagtaccatcttcagtttttatgtgaataagggaagtagggctcagagatgttaaataatttgcccaaaatcacacagctattgaggggatacagatgattctaacccaggtcttcatgactacaaacttcatgtttgttgttctgttcataatacctggccttctgctagtgttcccatctgagtttgccatgacatttgagatcctacagcaaatggtctgactgctcttctgggctagctagcctgcagctaggttagtttctcccagcacctgtggcatctgcatcagcttcctccttttcctcctccctagtggacccccacgtgcctaagcctgcctaagtcatgcaagtaggaggtaatggcaggctgattacttctacatgctcagtccccactcaccacaatccacaatatgttgagacattgttaccttgaagcaaaggaagtttaagcatcagggccccttactttcatgggcccctgagagggtcttagtagtatgggcacatggtaaattaggtataatcacaattagtcaaaacctctggatcttcccactcagacttccctctccatcacgtttccatctagtctggaagtgtggagtgctgagtcaccatgggcatttttaggatctggctaaggggagcatttaatctgggcttggggtgatatatttgtgtagttcttagttgcttctgttcatgcttaagtcactgctagtggtacaatttccacccactgtgccttctcccctggcattgcaacatgccaggtctagaggtctgttatgatatgaacacaccttatggcacccagtactctaggattctggtactggaataataacaaggtttgaatgtgtgggtttctaaacaacttttggccaaccacactagaaaatttgagcaatctttctatcctctctatggaaaataatattacaaaaaaagtttttacataaagtggtgatcaaagatttggcaacaaaaaatgttgagataaagtgttatagagatgtatcaagcagttaattaaatctttttctggatttggttatttgttagctttttacaatttgtaatttgctgtgattgatttcttttttcactattttcattatttacataagaaccccaatttcatacctacttttgaattcataattgtatattatttttcttaaaaggggatccccaaattgcagtccccacaagatcggatcttcccctgacagtgacatttataaaatgtctagatctaggcatgtgacttgtgaaaagtcgaagattttaagaacagctttattgttattagtgtttttctctttcctttgggaaattaaatggctcaaataaagaacaatctctgtcctttacctccctggtaccagctgtaatctagcagtgcccatccagcgtccatcagcatttaagcagaaaggaggacatgtgagatcgaaacggtcagaaaaacctctttaatgtagggcacagaattggaaaataatgcaaatgagttctctcaatgtctattagttacatacatacatgtacataaaatgtgtaagatttagtttttgcattctggggaataaccttgcaatacaaagacataaaattactcaaactttagtatgcccactaatattttctttgctgacaaacatatatagaagctgtatgtaacagtcatatagggaaaaaagatgtaatgacatctttaattatctcatttataaaactacttggatgaaatttccaaaagtaatcgttcaaactcaaggctttttttcccccccggggatgattttctctactatttggtttaagtgttttcaggttaaatgaatggatggacaaatggaaaataatataacacttgtttgtggatcaaaatttgattaatgatagaaagaccagcattgttttcactgatgattaaagtgaacaaaccaaaggaaagcttaagtaatgtgtttttacattaaattgtgatgaagtagacctataataaaattaatgctctgaaacctcaactggaaaaagaaaattatgaaacctactaatttttcaaactatatgaaaaaccttttatatataatgcacattaaattcatgtggatcagaatgaggtaaggaaaacatttcaattatgaggactggatttcatcccattcttgaagatcttcttgtaagcctcattctgtttgttcagacagaaaggctttttcacatttttatcaaacctgaatgtctagaaacaggaatgtaggctttcacagttcaggaggatttaaaaagagaactagataacaaagatcatgaataggaaccatatcggaaagcgagaaataggagttgacaccaaaacggacctttccctggcatttgatctgtacccacatgaacttggcccactctgtgccctctccttgggcgcaatcatctttgcgtgctgttgtggtccagatgtattcctcccggcttacagccaccccttcacaagtcccctgaccacaactcttttccatttctactctccttgtcaccactcctattttgattcttatcattaaaactttcatgcactatcctaatagaaaaagccatctcaaacacttctcttatatagtatgtctggtgtgacaacccggaatacgactaacatgtcatcacaaagccacataggagatgtggtttctccacccctcccactgtgagagggaaggaaaagctgccaggggtccctttcccctgctgactgactctggagaaatactcagcagaacagaggaaggctaggtcaaattccaagacaataattccagcagtaggagaatatctaaatcgactgtgagatatcatacttatgcgttattaaaatcactgagatggatctatatgtatgaaaatggataaatctccaagacatattgagtgtaggaaaaaaagtaatttcagaataatagtacctaatctgaaaatccaaaatccacaatgctccaaaatttgaaatgtattgagcacccacatgatgatcaaaggaaattctcactggagcattgtggattttggatttttaaattagagatactcaaccagtatgtataaggcaaatattcccaaaatctgaaacacttctggtttcaagcattttgggtaagagatatgcaacctgtgtctactacaatgtgtcatgtggacacagggctctggtacagagcaggcacttacatatttactgaatcttgaataaatgaatttatgaaaaaatatccagatacagtcacataaaataatgttacatgtttcaatggatatatatataaagaggaaactatacattatatatgttagatatatatttatatagtaaatacatgttaaaaatatataatcattatatcttatgtattatatgtaaaatattgtgtcatactgtatatattataaaatatctaatatattatttatattatataaatacaaataaaatatagttatacttttaatgtattttaaaagtaatgtatatattatttaaatataaataaataaaggaaatgatctcatacccacagttattactgggaaagtgggagaagcctgggagactggggtgagttgtcaaagaaaatttagtgttacttgtaaagttttaatttttttaaaaggaaaacatgtgcaagtattacttgtgaaatttaaaacttctatggcatcattcttgctaagctttatggatgtgttgccacatgcaacaaagaaaaatcttagaaaattcttatagtggctgtacatggcaaatcatgggttggccttaatgatacaatgcctagattaccagaaagccagctaactatggttggttcccctcacccctttcctgctctttcttgacctctaaaatcgcaggagttaactctcagttaaatgacagttgtacctgacttggaggggccctgggagcaaaggaaggtgagtagcaacatttcagagtagcaaatttc

SEQ ID NO: 240 - DNA, 10000 bp, Homo Sapien
aagagaccaataagttttaacagagctaagtagacccctgatgtactgcctaaccctagtgagaatctgggcctttcaacctttttttttttagctggggtctctgctgtctaggctggagtgcggtggtgtaatcacagctcactgcagcctcaacctcccgggctcaagtgatcctcccacctcaccattccaagtagctgggactacagtcatgcaccatcacacccagctaatttttaaattttctgttgagacggaatattgctatgttgcccaggctggtcttgaactcctggcctcgagtgatcctcccgcctcagcctcccaaaatgctgggattgcaggcatgagccactgtgctcagctcctttcaactttaaattggcctaggcacagtttctttgctcttcttttttctggctatcatgagtttgaagggggtgcccaagggccatgagtgtggctatggaggaaacactgatcttccttcatccacgcacccctcatgctggggaggtctataggcctccccatccccagtgcctgaggctgtgtctccaacctttctgaacacattttagctaggaagcaagaagatcctggatcttccacaccctttaagaaggcaagggatggcaatcacagtgataagagccacgtccaagaccgcttctggtggtggagaggttgcttacctgcaagtgcgtccaatgaggttttctccaactccccagcactcccactacctaactggtgggagcagtgggacctagagagcaggggttctgggcagatgacaacatagcttgcttatcttccaggatttgggtgctgtggggcagccacttgctacctatctctgagaatccagaaagaacacctggggtgcaagtggagagaagaagggtgctgggttggtcaacttcatctccctggccacgtttttccagaagggagatcttccttcagtaactataatgtggctgtgatccagcagccttaggaagccatcaactcccagctcaaatttttttcacgatttccctgacttaagcggagactgctgagctcccttggcaaggagggtgttaaggagctgaagggaatggcagtgctaagacagggccaaaaggcatgccttctctaaggttccacaggccagccccagggaacatggagatacggcttttaggcactggagcatagataggcatgtctagggcttccagaccatgctcaggatacaagggagggccaagagccaaaaggcacccaggctcgggaaagggttcagatccccgctctgccacttgctattacctagggctgagctacttaacacctttgagccacaagttttccacctttcaaaaaacaacctgtccccagtaggggtccaataaatgctgttgttaatgagagtgaagccgctggaccctggaggagaggaacggcccttggagtgggctgatggagggcggaagcactgggcagtgggcaggaccagaaactccacttgggctggggttgggagggggggaagaaaccctgactccagatggaggctcccactgggagaccctgggctggcctagggatgcgtccagagaaagtgtgctgcctctgggccaggccctcgttgctgtcattccccacaggccaacgcacaccacctttactgaccaggcttctgaaggcgttgaaggcttgccaccttaccaccctccagctggccccaactgaggcccgacctacccacaacccccaagagtagtgaatactcaaaatagcaccaatagtaccaaaccagaaggtaagtgtaaaagaagcacaacaaagctctgacccttcccatgatgattaccttgatacttcttcaaaagatagatacttttgggccctgcaccatggctcctgcctgtaatcccagcactttaaaaggccgaggagggaggatcgcttggggccaggagttcgagaccaacctggtcaacatagcgagactccatttctttttttctttttctttctttctttttttttttttttgaggtggagcctcgctctgttgcccaggctggagtgcagtggcgcaatctcggctcactgcaacttccacctctcaagtccatgcaattctactgcctcagcttcccaagtacctgggattacaggcatgtgccaccattcctggccaattttcgtatttttagtagaggtgaggttttaccatgttggccaggctggtcttgaactcctgaccttgtgatcctcccgcctcggcctcccaaagtgctgggattacaggcgtgagccaccacgcccggcctctatttttttttttaatcgaatacttttgatttctttttctcttttagccatggatagccctgcttcgctaagcgcgtgcgatgcagcacagcccttcacctggcaagcccggaagcctcaggttgactccatcagttttgccgggagagcccttcggcgctccccgcttggtgtctccaccaccccccgcaccggcctgggcgccacccttgtccgcgccaacggtccccgcatccctggccccgtgcgcctcctgcgccgttagcgcccagtccacgcagcaagggaggaggcgcgcggccgctgcgttccagggcgctctgccctcgttccccactccgggcccgcagcctcagagccagggtcccagtggcccggggcctgcatgcgtctccagccgtggatcccccggggcgcgcgccttgggagttgagctggaccccggctcgcacgcggcccacgcggagacgcatgggcactacggtcccagaccccgggccactgcatgctctgtggactcggtccccaggcacacccgaggtgtggaggtcacgcctgcaggcgcagagctcacagatggaattaggaggcgcctcctaacccccgcctccccccatcacacgccaccatgactacacgatgcagggacccccgacgacgtcccaggcattcctacagtggtcgcctccacaagctgagtccctgacctcagacccttcctgtccccttcacctcccctcgcactgggtgaggttctgagggttctgagttctggagaagaaggaggatcacaggaacacaggctcctgagtgggatcggaaaccttgtttctgaagtgtaaggagagaatatgttcttactgcgcacacacaggtgtggtgacacattttgttcgttttagacaagagtgactcagactgtggagggtcaatgaacactgctagatcctgagccctgctgaggtaaccttgcacccatccctggatattcccacaacgtctagtcaatccatttatgaggtcagagattgccgggaaggaagggaaacctagaggccaggaaaagaggctggggctgggagctgagggctcgcctgtcaggtgaagacccattcacgcctctttccaagagaaaggagaccctcacctctctcccattctcacgtgtccactgggctctggccagccctccagcaccctctctggtaggccctgacggagaaggacatcgaacccaccagaggtgaggaatgttttggatgcaggaagcagctgagaaaccaaaattcccagcgcgcacattgacaacctcttggaaagggagggaaggcagccactgagcgtcccagggcctgttttcttcttgggccctttctggtttccttcctcggtaagacaatgaaaatgatacactatcactcccggaaacgggcgggggcatcacaggatccacgcattcctgtgtcctttgcacctagcacaatagcagctgctccatggaagtgtgtctgctctgtgaatgcatgagtgaatcacaggtattgtcacagaatagtggggtcttagggtcataaagtcccttggaagggcaccaagtcccacagtgcatgtctgggagttgttactagaataagaccttgcaccaccgggtccagtggaacatgacagcccaaccccctctcacctccccactcctaccacacacacacaccccacacacactacacacaccacactcacacaccacacccaccacacacacactacacacactcacacaccacacacaccacactcacacccacacctaccacacaccacacccaccacacatgccacactcacaccacacccacaccacataccacacaccacacacacaccacatgcaacacacaacacacacataccacacgtgcgccacacatacatgccatatacaccacaaacataaccccccacacacaccacacatgccacaatgacacataccacacacacactagagaggctctgctcctgctggagaagacttgaagtctcctcaaaggaacagatgctccattcaggagcacaggtcaaaggctgtgccttcccttctctccccaaggtgaaaggccctgcttgtcatcttaggaagcagaaaccagcactgtgcctggcagagggtgatgagtggtgattttgctcctgccactggtgctgccctggggatggggtagaggtgggcacagctatgaggcaggctggggtgaggaccccagaaacccctcacatcacacatcccattttccaggcccttttttcttccctagttttgtacctgagggtgatgtttctctagaagagatgcagccctcagtcatgataaatcctgaaattttttttttttttttttttttttgagacggggtctctcaatctgttgcccaggctggagggcaatggcttcatcacggctgactgcagcctcaacctccctgggctcaggtgatcctcccacctcttcctcctgaataccttggaccacaggcatgtgtcaccatgcttggctaattttcttattttttgtagagatgggttttcagcatgttgctcaggctggcctcaaattcctaggttcaagtgatcctcttgcctgggccacccaaagtgctaggattacaggtaccagtcactgggcccacccctgaaggtctttgatgggggtgaagactcaggcacttcaagaagcagacctcaggccaggcgcagtggctcatgcctataatcccagcatttagggaggccaaggtgggcagatcacctgaggtcaggagttcaagaccagcctggacaacatggagaaatctcatctctattaaaaatataaaaatcagctgggcatggtggcaggtgcctgtaatcccagctactcaaaagctgacacaggaaatttcctgaacccaggaagcagaggttgcagtgagctgagatcacaccaatgcactacagccttggcaacagagcgagactctgcctcaaaaaaaaaaaagcagacctgtagggaacaggaggatcaaccaactgagataccacaagaagataggttctggctgggcacagtggctcacacctataattctagcactttggtaggccaaagcaggaggattgcttgagcccaggaattcaagaccagccgggacaacagagtgagatccctgtctctacaaaaaatttaaaaattggctgggcatggtgacacatgcctctgcctgtggtcccggctactcgagaggctaaggcaggaggatcacttaggcccaggaagttgagaccgaagtgagctgtgattgtgactctgcactccagcctgggtgaccgagtgagaccctgtctcaaaaataaataaataaataaaggaaaagaaaaaaggttatctgctcagacatgtaagctggccttgtggccaaggcagagagactctcatggcctatctcagaacagccacctaatgaccatcaaaaccttgacacactggcggggtgcaatggctcatgcctgtaatcccagcattttgggaagctgaaggaagaagactgtttgaggctagagttcaagacttggccaacatagggagactccatctctacaaaaagtttttaaaattagttgagcatggtagtgtgtgcctgtggtcccacctactcaggaggctggggcaggaggatcccttgagcccaggaggtggaggctgcagtgagccatgatggcacactctagcctgggtgacagagtgagtgagactttgtctaaaaaaaaaaaaaaaaacccaaaaacaaacaaaaaacaaccttgacacattcctctacaccccagtgtcccccttttctgttgtttaattttttaaaaactgtctctggcggtcaggcgcagtggctcacacctgtaatccgagcaccttgggaggctgaggcaggcagatcacctgaggtcaggagttcgagaccagcctggcccattaatgtagtgaagccctgtctctactaaaaatacaaaaaattagccaggcgtggtggcacacacctgtaatcccagctacatgggaggctgaggcaggaaaatcgcttgtgccagcaggtggaggttgcagtgagctgaggtggtgccactgcacttcatcctgggtgacagagcaagactctcaaaaaaaaaaaaaaaaattttatctggcctgcttaatgcttaagtgtttgaacatccccaccattttttttttttgtggcactcaagaggccatcccttccacctccatactagtcagtctgattttttccacatcccttctactcaagcatcaaagactgagaaaaatgagtcataaaagaacagatgttctagggtttcaacgtttattcctggcatgactaagaggacggaagagcctgctgacctcatcctacagctatacagggactcccaggccttgccccaagacgtacccttatgttttctgactgtagtaggtgggggcagactctaccttcagaaggaactacaagatgtttctttgttttgagatggagtctggcactgtcgcctaggctcactgcaacctctgcctcctgggttcaagtgattctcctgcctcggctacccaagtatctggcattacaggtgccctccaccatgcccagctaatctttgtattttagtagagacgggatttcaccacgttggccaggctggtctcgaactcctgtcctcaggtgatccacccacctcagcctcccaaagtgctgggattacaggtgtgagccattgcacccggccaggaaatacaagatgttaatgaaagaatttgagaacatgagcgaggtggctcatggccataatcccagcgctttgggaggcctgggtgggcggatcacctgaggtcaggagtttgagaccagcctggccaacatggtgaaaccccgtctctactaaaaatacaaaaactagccaggcctggtggcgagcacctgtaatctcagctactcaggaggctgaggctagagaagcaggctgaggctcttgaagccaggaagcagaggttgcagtgagccgagatcacgccattgcactcgagcctgggcgacaagcacgcaggaagtcaggggacctagccaggatacactgccttttccatcaactggctgtgtgtccttaacctccctggtggagccacttaacctctttggtacttccgtaatgtgaatgaggaggatagatggatataaggccccttactgctctaagaatctatgggattggatttcagttcagcatccatttccaggtttgcgctcatctttccaatgagagacacctgggcaggtagagcaaagagcaattctctggctgctggtatagtagacctaaggcttgagcaagtgcctgatacaagaagaaaaggaattgcccctttttcttggcagccaggacagagacccagtgcccaacctgcttatacctccaaccctgcccatccatcgcctgacagacaggagtgcaggacaagttctcgcccctcattgccctccctacctttccagttctggcagttccttgcaggctctccccaccttgggtttcctcccagccccgtctctgagggcagcaccttcccacatcctgacgcaggtcagtgtagctgtgaaggaggcagaggagtgagtgtctgagacacgagtgatccaggtccttcaagctgcagagtacatccctcacacacatactcaagattcctccagatggttgtcctagagaaggtggcgatgtgatttcccaggttctccgtgaagtagtcaagtattcaaactcctctatgcccttcttcctcttaccccttcattccctctatttctcctgcctctctcattgccattctttcttacattattttgcttccttcctcagttctccaggatcttcacctatttgtttattttgagatagcgtatgacttgtcacccagactgcagtgcagtggaatgtcatggctctctgcagcctcgacctcctgggctcaaataatcctctcacctcagcctcctaagtagctgggaccacaggtgcatgccaccacactcagctttttttttttttttttttttttttttgagacaagttatcactctgttgcccaggctagagtgtggagtgtggtggtggagtgtggtggtgatctcagctcactgcagcctcgacctcccaggctcaagtgatccttccacttcagcctctccccgagtagctgagactacaagtgcacaccaccacacctgcctaatattctgtatttttagtagagacagggttttgccatgttgcccaggctggtctcgaactcctgggatcaagcaatctgcccgccttgccctcccaaagtgctggggttacaagcctgagccactatgctttgccgaagattcccgtcttcccactgaaccttcctctttccttctcctgggccattcctgagccctggctgaggggagagaagggaaggaaagcccctcctgcggccatctcagcatccaaggcaatccttctggggctgctctgtctccagggccccagccatccccagacactgagtgcctgaggggggaccctcactcctgtggcactatggtaagataggaaacagtggcttctcctcaaagcagcctcgccggtcggtcagctgactaccaacatgggaagtggccgaagatccacatggaatgacactgataagcactttgcagtgtctgaaactcttaaacatcagtgctgtcttcctagttttacagacacaactctgtgggttggatgaggtttttctaaatgtacaaatgcagaaatatacggagggagtaaagggactgcctacaaatcacatctagagtgtggtgtacctgatttcaagtcttttattttattctcgcagcaacgggagaatccgcagtcgagggaggtgaaatgacttgctgaacgccacacggcggactccaagccccgagctcctataacagaggaggaggaaggcgggctcagctcctgccacccagcagcgggggagatgcagcccgggactaggctgggccatggggacagatccaggccccgccccctgaccttgttctctgcccgccgggaagtggggaacttgcggggagcagcctcagctagtccctggggcagagtctccacttgggtgcacgccctggggtggggcttcttcgggaagccgggggccttcaactctgctcaggagctcgggccggagaaaggccccgagacttgaagcccttgcccgggagggatgaacacgcaaaggaacccgaggaacggggtaggggaccaagagtaggaccagcttctcctgcgcggggacagggcctgtggagcggcctggaggaatctctcccagccgcgaagcccgggaaggctgcgaggccccagcgcggagcggcccctcccacctccccgagggcaggcggagcgaagcctcggggcccgggcccaggttttgtgcctacggaggctggacttccccgccaccccgaggagtcaccgagagccttctctccctcgcaggggccctgggaggcccgcgctttctctgaaagtggaaggagtgggcggggggcgcggc

SEQ ID NO: 241 - DNA, 10000 bp, Homo Sapien
ccaggttcaagcaattcttctgcctcagcctcccgagtagctgggacaacaggcacccaccatcacgcctagctaatttttatatttttagtggagacgggggtttcaccatattggccaggctggtctcaaactcctgacctcgtgatctgtctgcctcggcctcccaaagtgctgggattacaggcgtgagccactgtgcccagccttctgtgtattatttcagccacttttcctgtggcaagaaaaagtgattccaccatggtttatggctttttgcttttagcatttaatgaagaaatctcaagctgtgcatttatcatttcttaatgaaactttgtaaattactaaatcgagtattgcatgactttaagcactgaagagattgtagtggcttgtcttcatgtactgggcatttaaagtttaagtctcattaatcacattggcctcataatattagttaatacctcaagacccaacatacatttacagtgaagaatatcactattaatagtaaatgtaaatccatggtcttaataattgaaactgtttggggaatgacttcttagatggtaaatgttttcagctgatgactgagctcagaatgtaaacaagggaatcagcggactttgattttaatgaaacctgtgtataccccacgcgacaccctgggccagggagcaggctgggccagaactacacatattagatggaaggagggatgaacttggatgtgctgatgatgtggacagggcagaggaagtcagagaaacacagagcatcaaacaagtggcccacagtgaaatgcatttccagaacacactcccagactcgactcacatttccgtgcatctgcatttacccagtttagggacactccagtgtctcttgaacaaccctcttagatttggagactttccatcttttgagtcctgcctacctcaggcagaaaccagaactctccttctcagctcccttgtaggtagggcacagacatgtaacttaggatctaatgagatgcactcacaagagacttactcaagaggccacaaagaaaggacgcaggcactgcagtgagcccactttctggtgggatgcaggtggaagcgtcctgctcctgggacggcagcggcactggtgagtgggtctgggctcaggggatgagctctgatggtatcagcttgggcgggagcagtggggctgtccctgcagccttgtggtgtgtctggggccttgtttctggctctgtttcctcctctctcagctctctggccctcctagacattctgtgaaccgcctaacaattttaaaataatttcctttttttcccctcaaattagctattctattgttcgtgagctgcaagttgacaaaaattccactaagggccaactcactgaactctaatgggaaagttgtacctgttgccttcatttgataaaggagacagagttttttttaaaaaaagtgatgtgagaacaagaattatcagtgtgaaaaagaaaatacagatctcagctcgaataagtcagtactctgtggtcctaaattagaattgggagaatcaatatgaacatgatgggtgttttatctctttcacaaagttctggctttgtctaccaaaagccccagaaacaaagaccagctagaaatgaacatccccttagaggatcacttttcactaaaagctattaggttgtcttaaagaaacagctgattgcatgtgtgggcaggaaaagtacaagttgaaactgcaacatcataccagaaaataaacaaaaaatcaaagatgacaagaattgggtcaaaaggactcagagctgacttaaagaaggtcccaatggccaaagagggtacactttgaacatcagtaagaataaaaacagcaatgaacccagacatatcaaatatgtttgataccaagagttcataataatacaaaaacaagcaaaaaacaagtggtttgtgaaagcagtttgtgaaaccccgtctccactaaaaatacaaaaattagccaggcgtgatggtgggtgcctgttgtcccagctactcgggaggctaaggcaggagaatcccttaaacccaggaagtggaggttgcagtgagcagagttagtgccattgcactccaacctgggcgacagagcaagactccatctgaaaatgaataaataaacaaatacatagagactcgggcatttatccttcctttcctatacaaaccttaccactgggtaaccaaatagatgatgagaaatttcactttctagaagtattccagaaagtaaataagcaaggaatgaaacattgaaatcttgccgttaccatttcctcacaaatttagaattcaagcacagaactcacaatatgaaacaaccagacacgtcacctgttgaagaacacaccagcccctgtgaagtcatcttccctcccgaaaaagcaaagctttatctgctggcgcctctggatatgacagtttgcggggaatacaaaggacaaggaacccatgagatagactacactatgagaacacaatcagcaaaatcctgactgcaggaaagtctccagaacaaatgatctggtttcttcagtaaataaactgtaaaggatggtgaaaaagatgaagtgggaacctaaaaattaaaagtgaccagttgggcatggtggctcatgcctgtaatcccagcactttgggaggctgaagcgggtggatcacttgaggtcaggagttcgagaccagcctggccaacatagtgaaacccatctctactaaaatacaaaaattagccaggtgtggtggcatgtgcctgtaataccagctactcaggaggctgaggcaggagaattgcttgaacccagggggcagaggttgcagtgagctgagattgtgccattgcactccagcttgggtgatagagccaaactccatctcaaaataaaataaataaaataaaataaaataaaataaaatttaaatttaaattggccagtcacggtggctcacacctgtaatcccagcactttgggaggcttaggcgggcgaatcacgaggtcagaagttcgagaccagcctggccagcatggtgaaatcccgtctctactaaaaatacaaaaaattagccaggtatggtggcgggcgcatgtaatcccagctacttgggaggctgaggcaggataattgcttgaacccgggaggtggaggttgcagtgagctgaggttgtaccactgcgctccagcctgggtgacagagcgaaactccatcgcaaaaaaaaaaaaaaaaaaaattaaaattaaaatgacctaaaagacattgaaaacaaaaagcaggcagaaagtaaactatggtgcaaagagagtcaagcctggattgtaaaaccatataaagaaaaacaaggagatgggcatggtggctcacacctataatcccagcgctttgagaggctgaggcgagaggattgcttgagcccaggagttcaagaccagcctgggccacatggccagaccccttaccacagggagaaaaaaatctttctatacaagatggccaaaaaaaaccccaaaaagttagctgggcgtggtggcgcacacctgtggtcccagtaactctggaggctgaggtgggagcactgcttgagcctgagaggtcgaggctgcattgagcccgtgactgtgccattgcactccagcctgggcaacagagagagaccatctcaaaaaacaaacaaacagccgggtgcggtggctcatgcctgtaatcccacccagcactttgagaggccgaggtgggccgatcacgaggtcaggagatcgagaccatcctggctaacacggtgaaaccccgtctctactaaaaatacaaaaaattagccatgcgtggtggcaggtgcctgtagtcccagctactcaggaggctgaggcaggagaatggtgtgaacctgggaggcggagcttgcagtgagccgagatcgcgccactgcactcaagcctgggtgacagagcaagactctgtctcaaaacaaacaaacaaacaaagcaaaacaaaaaaccaagaaagtaaccaccatccatgtcagtagagtggtcactcttactggggagaggagggattgttttgggaatgggcccatggagggcttggcatgagggttggcaaggttctatctcttctcacatctggtcttctgttttcttttcttttttttttttgagaaggagtctcgctctgtcgcccaggctggactgcagtggtgcgatctcagctcactgcaacctccgcctcctgggttcaagcaattatctacctcagtctcccgagtagctgggattacaggcactcgccaccacacccagctaattttttgtgtttttagtagttttggtgtgagccactgcgcccagactcacatctggtcttctatggagttgccttataataatccagtaagctgtatatttgttttatgctgatttctatatttccaccacatttaacaataaaaaaatttgtgacaacagtcccggcacggtggcttacgcctgtaatcccagcactttgggaggccgaggtgggtggatcacctgaggtcaggagttcgagaccagcctgaccaacatggagaaaccctgtctctactaaaaacacaaaattagccaggcgtggtggcaggcacctataatcccagctgcttgggaagctgaggcaggagaatcgcttgaacctgggaggcagaagttgcagtgagctgagattgcaccattgcactccagcttgggcaacaagagcgaaactccgtctcaaaaaaaaaaaaattgtgaaaacatttacttgcatttttccttattcatgtggtctttgaataatttaacaaagactggttgagtgcatgctggggatgctaacagacactggtccatgccttcaggagttttgcgcctggagaggaaaccattctctgtaaccacaaggcctagagtggagcagagaggaaggagagcttgcagggctgtgtgtagcccacaggagagatgatggtggcgtggaatagggacacagcaggagggaaaaggagaattagacaggttccaaacatgttttaaaggtagaaccaactgattggtgatttgtttgtgtgtttgttgtttgtgggtgggtgggataaggaaaggagaggtcagtgatgtcttctagaactggttgactaaatggatgaggaagccctttgctaagatagctggatccagagtagcataaacaaatgggtgtttgtggcacacaaacccgctctgctgctgcaaaaggaggggtcatcttctcccctatattcctagaacatcatcttttgtttagagatggggtctcacttatgttgcccaggctggaatacagtggctattcacaggtgtgatcacagctcactgaggcctcgaactccagggctcagagatcttcctgcctcagcctcccgagcagctggaaccacaggtgcctgccacagagcctggcctgctagagcgtcgtctttcatctcagagctgaatgagcatcttgcccacagaagtgctcagtgctggcatttgaatgctatccatatgcaatgcatcagctgcaaattcagatgaagaggaagccacgcagaggccaagcccttccccctaggaccgctgtgccgcaccagctcatggaagtgcaggagccaggaggaagcgtagccatcaactatcacatcagacccatttggtttaatcctcatgaaattatgatatgctggccgggcgtggtgggtcatacctgtaatcccagcactttgggaggccaaggcgggtggatcacctgaggtcaggagttcaagaccagcctggccaacatggagaaaccccatctctactaaaaatacaaaaattatctgggagtggtggcacgcacctgtgatcccagctacttggaaggctgaggcaggagaatcacttgaacctgggtggaggttgcagtgagccgagatccgagattgtgccattacactctagcctgggtgacaagagcaaaactctgtctcaaaaaaaaaaaaaaaaagaaagaaaagaaaataaaataaaaaaaagaaattatggtatgcttttgtttctaaactcggtgaagagacccagtagcagacagcttacttgacggacactgatcagctccacagactgtcctcgctcactgtctccaaacagcattttcagtgctcttatgtgtatcaggaagatcaaaatacactataccataagtcctaagtgacggaagagattagttattaaattctggggaaagttaatcatattcactttgaaactttagctgaatttggatctcactaaggggaaggggccaagtcatcggggatggggtgggaaggaccgtgcaggaaaaagcagcattacctcaaggatactaaacacctggcgtttagaaagtgcattttccccatgaagcatgtttgacagggaagcatgagggctgtgccaagacaaaagcagaagtggttctaggtgtcgaattcatataaaccttgttgtttcagaaggtttaggtacatttatggatgccagctccataaccggttcatttgactttattctgttcattctcaacctctaccacacctctttgctgtttgcacttttcttctttattgaaggagcatgagtcgcctgcaggcctggcacaagctgctctggtctccccgccttggatggtaccagagcactggctgtttcacacttgggctgggcctacctcacatggccctactgtctcccacattgtcaccagcttcagccagtgtcctttagcctgtgggcaggtccacatttgcacaccttctaagtggtcccggccacaaggacataggggcttgttggacatgcccttgagggggtcccagggacacagatgtaactttcccagcaggcagtcctggaaccaggaagaggatggctccctggagaggagcgatgacagctttgcagtgctggggccggggaagggccagtgagggggtggtggagaaggcacagtgggtggtgaaggttgggtcatttggtcatgagtcactctttctatagcagagaaatgacacggacctcaagccaaaatctgggcttgagttggatttgttccttgtgagtgtgagaatctggtcctgttctggaggctgtctgctcttgggttccttcacttaccatttaggaacaaaagcactgacatttcataattttttgaggattaaaccaaatgggattcatggaataacatatggttacactgcctcctccaacccaggagtgcacatagggtgcatgcagcaaggtatccccatgcagccatcctaggggaagggtcttgtcctgcatcgctttctcttcatctgcactagcagtcaatgcattgcattcatacggcatccaaatcacgctgagcgcccagctctacgagataaaagatgaggccctaggaagtggggagacaacgtgagtcactgcgtttgcagcagcacagaaggtctgtgtgtcaggagtaccatctcatttacgtcacattgaatttggcttactttccatcactcacactagttgaagaatgctgtgccattggtaatccaaaggaaaatttatttttatatattttctttttcttttttttcttttctttttttttttttttttttgagagatggagtctcgctccaggctggagtgtagtggcatgatcccggctcactgcaacctccacttcccaggttcaagcaattctcctgcctcagcttcccaagtagctgggaccacaggcatgcaccaccatgtccagctaatttttgtatttttagtagagatggtgtttcactatatgttggctaggctgatttcaaactcctgacctcaggtgatccacccacctcagcctcccaaagtgctggaagccaacgtgccagccttttagaaatattttctgtttagctttggaatgctttatgtgatggaaggcagcagattcattcttctttcaattaaattgacccaatatattgtgttagtcattgtgctaggctttgagggtgcaaaggcagttaagacacagacagaaaatgcaacgaaatggtggtgagctccatgagagaggtacaaacagagctagttctggttgagagggaaggaaactcctggggaggaggtagcatatcagtcaggaagcgtgaggtttgcagcaataacaaacaaccctcagctctcggtggcttaacatcccaaaagctgactgactcctcattcatgctacatatccagtgtgtgtcattgtagccacttagggtcacaggtcacagagttaaacctctcagaagagagcagggcattgtgcagtgcctccttatgctgctatgtacaagtggtgtgtcctctcattggacattttcttggttaccgctagccatactgccatacctaacttcagagaagagagagtaacaccctggcctgtgcccagaaggcagagagctaaaaacattcaatgaacaacactaaaaaaccccatcggtgtcttcgacccaatatgcggaaggagtatgaaggagaagagcttccaggggatgaaaagctttatgaaagctgccaagatcagaacgcctggctggagagaggggctccaaacaggaatgcttggaggcacggtgttaagggaggacagggcagagtgtgaagctgggctaaggaggttggatttgatccgggagacacggaaagtcataaaggagctgtggtttcagatttacctgactgctttgtgtaggagagatcagagggtggcagcccagaggcaggagatctttcttaaccaggcaaagggctctgaggactcgaatagcggtcttctaatgcgcaggaatggaagggctatgcttgtcagcagagtcttgatcagatttggaactaattggatatgagatgtaagcagggtggagaatcaaagatgattccaggatttgagcctgggagaatgctgccattagaattagagaaaacagtggaaaatgggcaagtcagggaaggaagatggggcttgttgatctcaaagcagggatttttattttgttcactcctgtttccctgtacccaggacagtgcttagcgcctagtgtgtgcttggtaatgttcattggctacagaatacagtagaacataaatggagacgtccccaggcgaccgctaaggcagaactggcactccttggtggtgtctgtgctgggagggaggtcttcctgtctgaagtcgtaagatgagacgtgctgccaagagaaaaagcttagagaagaaagggatgaaactgaagggagaactttgggaatcatgacatttaggactagaaaggaggaccggaatccagggaaagggggcatttgaggaagcatcagatgctgcaagtgggcgaggggcgttgggatggctcagagggcatctggtggcacagctcatgtcactgggcctccccagggtagccgggcgcaggccagcaagcgcctcccgcctggagaacaggaggctgcgtagccgacggggagcctgggccaggggcggttctggtttctgtttggttttggggggttcataaatgcgatttagtcctgtagcaaagtgagcaaggtgaaggggagagaccggaggcgcatgagggaggagggaaaagatggttggcatcaaggaggtggataaagggctgccctcccggggcagggcccctggagggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtga

SEQ ID NO: 242 - DNA, 10000 bp, Homo Sapien
atctccaggacacagtcaccaaacccccatcctggtattactggcattgagtgccacgtaggcacacagcactccataatttggaaatgtggatttcattgctattgctcttcatgagggaacaaataatatccatgatgtattggcaggaagccacgccccccctcccccgctgccacccccacagcgcgcacagtgatttcaggaaggaggtttgattggtttgttgtgtgttgccctgcaagggccccaatcagcttcctgctcatcagccccatctcaggcaagtcccacatctgtgatgtcaagccctgagccgggtaattggacttggatacctgcttgactcatctttccagtgaggttcctaaggagcatccccaaccccacctcccagggggagctctcgatgtcacctgaagaacaaacaaacaaaaactgtgttgatggtacagtcccagggctccgtgactggacaggctccctgcgtgatacacctgtgtatgtcactacagaaatacagctggtgcaggcctgtccgcctctctcacaggtcagagtgttctaaaatccatcctggcccttgttgtctgtctgcttggggttagggcaggtgctcctttatcatttgtaaagtttatgtgatgtctggtatgtgttccacacccttgcagagtgtaaattcctagagagagttcagacttcggagtcaaatgcacaggtgcaaattccagcttgtctaatttgctgctgtgtgaacgtggacagtctttcaactttgctagtttcccatctgtaaaatgaggctgttcagtacctgagcacatagcattgttgagaagattaaatgagacaatatgtgtaaaacacttagcattttacccagagcttggtaagcatcaatacatgctaattatcatcatcatcagaagatgaatatatttattagatgcctaaaactccaagatatttcccttggctcataaattctttatcactagggatttctctatggaagtgaaggaagaatctggaacgtaacaggcctgaataaccaggggcagtggctcacacctgtaatcccagcacattgggaggccaaggctggaggatcgcttgaggccaggagttcaagatcagcctgggcaacatagcgagaccccatctctacaaaaaaaaaaaaaaagaaaaaagaaaagaaaaaattagcgggcattgtggcacatacctgtagtcccagctacttgggaggctgatgtgggaggactgcttgagctcaggagttcaaggctgcagtgagctatgattgtatcactgcactccagcttggtcaacagagcaagaccctgtctcaaaaaagaaaaataaaaatcctgaataatatgtctatgtcttcatcgagcccacgtattgaaaactacccaaaccaccaacaatgcaaagaaacattatttaactaagagtcgagtaaccaaatttcagggttatccaaactgaatatggcctctgcaggagaaaagaatatgtgtgatgtggcagccacaatctgataccatattaacactgtcttttatttttttttttttgagacggtctcactctgttgcacaggttggagtgtagtggcacaatcttggctcactgcaacctctgccttcaaggttcaagagattctcctgcctcagcctctgaggagctgggattacaggcatgcaccacacatacctggctaatatttgtaattttttttttaggagagacagggtttcaccatgttggccaggctggtctcaaactccagacctcaggtgatccagccaccttggcctcccaaagtgttgagattacaggcgtgagccaccatgcccagtcaacagtgtctttaaatgacatcagatcgcagaactttgctgagcttggcccagacacaggtctggctaaaacaggtggtgctgggaccaggcatggccaggacatagggaagcacatccctgcatagaaaaggttctgtggattttaatccaggtcagcaattagcaaactttttctgtcaaggaccaggcagtaaatatggcggcttcgtgggccatactgtctgttatgctgactcacctctgctgttaaagaacagaagcggctgtaggcaacacgcaagcaaacaggcatgtccaaaaaatggctaataaaaacaggctgtggggctgggcacggtggctcacgcctgtaatcccagcactttgggaggctgaggcgggtggatcacttgaggccaggagttcgagaccagcctggtcaacatggcgaaacccagtttctactaaaaatacaaaaattagccaggtgtggtggtgggcccctgaaatcccagctactcagaagactgaggcaggagaattgcttgaaccagggaggcggagggtgcagtcagctgagatccagcccactgtactccagcctgggtgacagagtgagattccatcttaagcaaaacaaaacaaaacaaaacaagcaagaaaacaacaacaacaacaaaaaccaggctgtgggcccattttgactgaggaccttggtttgcatatccctgatctagagaaatgagtgatttaacatatatgcctcctaggacatatcacattgaaattagcagcccttgcaatataacgggtcatgagcagagggtgcatttcactttgggctttggggtcttcccgggccctggaacccccaccggctcccagccccaggacgttggaagctgagaggcctggcttccaatcccagccctgtcccttgctcgctgcatgacttgggcccattgcttggcctttctgagcctcagtttccctagctgggagagtgaagatggcaatttcttgcctcgtagggttgtgaggacaaaagaagaaaactcgggtggattgtgtagcctggcccccattctcagaaggtctccaagcggtgccgtcttcctcttatcccagcgtggcctcagccttcgagaggcctagaactctgggaaaggagcagtcaggactggacacgactccaggcttttcttatttcttgtgtggggtctggaaaaggagaagtgcaattatatccaaggcccctcttgggcaggggtctcagatccaggccaggctgatatgagcaaggggaggcgggtcaggccaggcagcactgtcaattttgatgttgggagggaggaggggcatgactgtgtatcagcaaattcctaaatttccaccctggctcgggagatgcagcttgtgctgaagtgagtcacttattcctgggcccctcatctgcctgcttgcttccatgtcccctagagccaaaaacaactataggagcaacttaggggaaaagttacctatatttatatataagcgtatgtatttatatataaatatgataactatagatataatctaatatattgtgtataatataaattaaatatatttaatgtaatgtatataacttaagtatattatatattcataactatataaaatatataaatatactaaatattattcactaggttttcatcattggcaacctaagttctatataaatatataaatattatctatgaaaatttatacacaaatatgtatataaaatgttataaatatatacatacatatttaagtaaaaataatatatacataaaatatattatatgtttatatagatttaggttggcaatgataaaaacttaatgaagaatttttagtgtaataaaaactagtctcgtggtagctctttgtgtttcagaatccagctatttggctctgggcccgccctctgttactccgagaaagcactgctttggaggtaacacaacgctaggtggcccctgaggctccctgagcaccgtccgatacccctctcagaagcacctctgccccctcctctgtacagcccgctttgctcgcctgcctcttcctttggattccaggttggtcggggaagcaatgggccatgtgtgtgcaccgtctgtgcctgccttcacccacacgagcctgttggaagacgacagccatacggaagaccgctgagctaccccggccccccagcccaggctagttggggttacccaactaccagccaatccccagacgtgaatgtgaataagcccagccagcatcacagagctgcctcgtcaatgtctagctgaccccagatgccacctaaacaatttgggtttctcacggcagttctcttcccaacctctgttcccctgggttcctaagaactaagggttgtgcccaccaatcaaagcaagagggaaacgggccttggattttaaggcgttgcactgctgtgacttgaaaagggatatggtttaaaatcattcatttaggccgggcatggtggctcacgcctgtaatcccagcactttgggaggccgaggcaggtggatcatgaggtcaagagatcgagaccatcctggccaacatggtgaaaccctgtctctactaaaaatacgaaaattagctgggtgtggtggctggtgcctgtagtcccggctactcaggaggctgaggcaggagaatcgcttgaacccgggaggcggaggttgcagtgagccgagatcgtgccattgcactccagcctggcgactgagcgagactccatctcaataaataaataaacaaacaaataagtaaatgattaaaaatcagtcacttaaagacgtattctaagatgagaccctcttgctctataaaactgaaggtcgtgtccactaagaagagtggatctgacctcagccctgcactgtgacgccacattccattagggcagaggaacagcatctggcaagagaggtcgtcccagaattctaaagaggcaggatggccctagtattcaaacttggaccacacagatctgcacgtctctcatcccagaaaggagaacccaaagtatgtgtctcggttcatgattctgaggatgagggaattatggaaggcaccaagtccattcataaaacacaccaccccctccctgtcccggttaatgacagtgggtggtggcttgagcatcaaagtggcccatgatgtcttggttttgctatctggttatgccatctggctttcttggtcttcgtccattcatttccctggagtcctggccatgctttgcttcttactaaccttatgcagaagccaaggcaagcgaggacgaggcatacttggagtattcccactggagtaacttctgcaactagaagctttagagctgtgactgccatacagagccaaagaaatgtaaggtgcagggcgagtgagggtcttgggaattgctggagataatggtgctctgtgcttgcggcgagagcagtgaagtggtgagaccagtttctgaatgtaaactttttatgacaacggctgcgaagatgcccaaagtgggcccctgttgcctatcactgaggttttgaggccactttttagggagtaatgctaggcgatacagcccctccctaaccaggcttgcaatggattgcatgcctgttacattttgagtgcccaggtttctggtggattctatttgccagtcactgttggtttcaaatgtgaagcatctttgctataaatagactctactgagagctgcatgatttgaagaaacattatacctgtaattacattattttacttgaaatattagtaaacacaacatgaactatgtctatttgaatcagtgtggtacagtttgtacgttcaaaacctgagccttaatacataaagttaacttcatttataaaatgctcaaaaataggcaaaaataaactgctgtttagagatgcaaatataggtggtaaaactattaaaaatcaaggttctgtttataattacaaaatgcaagatattggctatcaacagaatagaaacgtagaggatgtgtatatcccatgggcagtgctgacctccttgggggcagggagtgggtgtcctccaacatatttatgtgtcctcagagcttccccagtgctgagccttttccttaacaggtggatgggtacgtggcagttttgtgctgattcgttttgaatgcatactggctacatgtgtaagctttcctaagacaagtgaccacagcactgagagggtattactgacctcttctagcaagaaccacacaaaacagactcctgacagtggggtgggactggggtccctttaactggaacaatcacctgcagccctttttcttgcactacaaaactccgtggctccatcacaccaagcgatcatgctctgtctccagagtatcagctcacttggtgtctggagaggaggaggatcaacatgattctcatgctgaggaaagttatattaaactaggaattctgcatctttggagttgtattaaacccacctgcacatttaaatcaattacgcggtgatttttctcttggaaacagtctcactctgcctctcaggctggagtgcagtggtgcggtctccactcactgcaacctctgcctcccaggttcaagcaattctcatgcctcagtctccagagtagctgggattagaagctcttgcaaccatgcccagttaatttttgtatttttagtagagacaaggttttgccgtgtttcccagtctggtctcgaactcctgacctgcccagctctgccttccaaagttctgggattacaggcgtgagccaccgtgcctggccttctcaagtatttttaacgtgccacactgttgtttaataacagctcaaagggcaaggtatgcagagtggctgaatttagaggggccacagcagcataggggtgttctgggttggaattctgtctcttctgctacctccaacctaactttggtctagtttcatatcctccggaagcttctgtttctcagcccttgaggggatattgtgcagataatacccatataaagggcccagcacataggtgctcatggaacgagaactatctgtgtatatggctcactttataaacctgaaatacatattttgaaaataagaaaagagaaacgaagtgaatatgttgattgttactatcatagttgttctgggctagttgttataatgtgctcattatgctttcatcttaatagtgattactgagaaagcactgggattttccatgctcattcagatatcctctttaatcacaagcattagtgctcaccacacaagggccccaaagaactggtgttgcgtttgttggcctctgttctgaatggcatctgtttgcatccttgagggaggttttgctcaggaaagggttatcagtgagggcgggatgccctaggcaaccttggacaggattcagtggttgggaaaggagcggcagcctaatacctcagccacatgctggccgctcagtgacacaaacctccaggtgcacggtcattggcagacactcctgtaggtggcaatgcaggcaccatcaggatgacatcactttcatccatggggcttttcagtttatttggaaacaaaattgctggctgataatattaccatggacagagtgggggtgtgttactttcagaaggagggcactgtcatgtaacctcagcatccagagcagagccaaatgtgaagctcacacctcggtccagcctccgctggggccgctgagtgcttatagcaaaggctgctggtccatatgcaagagggaaacaggtcttggtttctaaggcacagacgggctcctttagcctagaattctggaggggaacctgatcctgtgaagtgtttcttgaaacttcgtctgattcctggaagaagcccagagtcttatttgagatgagactagtatgttgccacaatgtgctgggtgacaggtgtcgaggcatcacatgtgctgcttcctggaaagtgcattaaacaggcttcagagacactctgataaaggaacagaaggggcatagttataataggaaagacaaagggttagtacccgtgttttcaaaagattgacaataaacaaacaaaataataataataaaaaaagattgacaataaaccaacgaggaaaactcagttggtgcaatgaggaaaatggatgaaactatgaatgatgcttcactgatgaaacacaacccacttgtgaaaacatgctcagcccaatagaactctgggacatgcaaattaacatgaagtctgatttttttttttttttttttttgcctctcaggtgtgcaacgtcccgggtgagtgacttctagggagacagcgccatcatgccctattggtgagttggtgcccgggaaggtcctttggaggtgacaatttggtggtttctacttaaatttaaaatgtgccctttgacctagaaacttcacttctagggaattctcccatagaactagtttgcacgttagcaaacatacacacatgcaggagtattcattatacagttgaattatagaattgcagcatgtggaaagaagttaatgtctgtcactggggaggtggaggtgactctccagactttgttatgtttatactgtggaatgccaagcagccattaaacagaagtaggaagctgtgtacgtgctgacatgtccaggcagaatgttgaccaaagagggccatctgcaaaactgcccatatgtggcagatttagtcacttctaagacacagtactttcacatattaacctccctaacatcaggattatcacaaaattggtgggatcttacaggaataaatggcagtatttttgctttcttagcagagcataaagtgattttgacaatggtagtcctggatttgatgatataccaggagtttgactgttgttcataaaagcaaacaatgtatatgtttctgtaactatacagatttaaattgcagagtgttgtctgtttggagatgtactccaaagttaccaatggattgagatggggagaggaattaggaaaagggctaaatgctcttggtgtgtttctgtttggtttgaatgtttgtaacaaacatgtctccctatattgctggtattgccccgtcctttgagacgaggggcagttggctctgttagaccctgggccaagtgggagaccagctgtgggcactgaatgtggaagtggcaatgtgagccctggctggggcatggctgtcttgggccctgaagctgccctcccagcaaaccagcagatggcctgagggcccccagggatgaacattgctcccgactgacacacagctgccacgcccaatatgcaagctgttagaggccaagcttgggagcttggtgaccacagcagatgccttgatgttgtgcgccactgtccctgggtgttcctctgattttggcaacagtaggcccacacgtgggacatgcatgtgccagggagctgacagccctggaacaaactttccacctggtgggcgagagctgtgggtcagtgctgcagcatcctgctccttcatgcagaagatgtggggaggcccctcgcacatctctgcagagtagagttcccagtgtggtctcagtaatgctcctctgagtggcttgctcagacacacacactaatcggtgcccctggctacctgtctgtctctcctgaggtccctcagcactcagcgtcctatctgtgtatttctgttgatagtagctgcctttgaggctggtctggcaagcgtacttttgcagacctcagctccttcagaggcgttgggctcaggcagggctatttgggttcattggcccctggtggaggcccagttggtgacttcctttatgcctcttccatacctccttttccttggatccctctgcccctccccactgtgtccagctgtgcctgcaccttcatgtatccaggtctgcttaccccaggggaagggccaagaccacatccacagcagagtggatgctgcttgtctaggatggaacattgggacccacagacccatagagagaaactggtaacaaaagggcccacaacagcaaacaccatctcacagcaggcgatttttttttttttttttttttttt

SEQ ID NO: 243 - DNA, 10000 bp, Homo Sapien
gatcgtaaaaatcaccgttcttcatctgtggatcagcagcttctcctaacctgtctatttcagaggcattgcaaagatttttctttcggttcatccagcttaatggccagaagttcctctgcagagtaaaaaactgctccaagcttttgccctcactgcctctcaccctctatttctaaattggccagtatgtgtgagcccattgtggaaagtctgttgctgggaaacacaaggaagcaacttcccctgaacggatcctttcagtttgtatagacaagagtaacactggatttaatgggcagtaggtagagggtaaggggatcgttagtatgtttcctctgaagaatcaccagtaatatgagtcagctgtaaataccagttgatcaaatattttaggggctgtaatcccagcactttgggaggctgaggcaggcagatcacctgaggtcaggagttcgagaacagcatggccaacatggagaaaccccatctctactaaaaatacaaaaattagccaggcatggcagtatgtgcctatagtcacagctactcgggaggctgaggcaggagaatcacttgaacccaggaggcagaggttgcagtgagctgagattgtgccgctgcactccacacttcagcctgggtgacagagcgagactctgtctcaaaagaaaaaaaaaattagaggaaaagatgaaagggttgagatgaagaactgaaagatgaacatctccctaccctccaacctattaggaaagataaattgttcttagaaactgtgggggcagaaggagtcctggaagaatctagaaatgagaattctcataaggcaaagagggatttatgctgttattagagcttgaagagttgaagaatgacacagagaagttgtttcactggagcagtcggaaaaaatacgaagatttgccagcactggtgaatataaaagtttcaggaaagagaagtccattctgactggaacaataaaaagaagtcactgggtccatcagatccaaggaaaagacagagcctgtggttgagactccccactgcagtgttcagtggtggccatgctgacttgacataattctccccacaaccctccacaaattatctacctggacatggtaggctccagacagcattcatctggccaaggttcagctgatctcctcttttgctgatttgcgtggaaaacggtgaaacagaagaaatccaagtggatctctactgacttaaaacacctgagtaggaaataaaacacacccttccctccattaaagtccaggactgggagatgaaggagggtgactacacagcatcaaagagcagaatttggtcatctgggcctcatatgacctcctgaaacaaattaaaatgtagctaatgaagactgcaaagaaagagtttgccactgagctctctgcttctactctcaccctctccaagtcagcctaccccaggccacctcattactgttcacaaacataatttggatcaagatacatctgacctctgagacctctagtggccccctttccaaattgaataatgtacccatgtctcagcaaggcattcggggcttccactctgcatggccccaagcagcctttccagtttatccctcattccagcctccatgcagcctgagcttcaccaagataggctattgccattccttggggccgcacatgctgcctctcctccatccttttgttcctgctgtctgctccctcgacacatatcctgcatcacctcttgacacccaaatcctacacattcaagacccatctccagctccttctgatattctttctaatatgactttgtacctcttaaggaagacattcatcttagctcaccttgtacttgaattacttctaggtcttctctccatttggttgggagctctcttgagacagggactatacagcccttatctttgcatctgctgcagcacctagcaaggtgccttgtacatagaagtagttcatggatagattgaaaagaataaatggaggctgagaagagtagacttgtttgtgaaaaatgacatacaccattgtgaaattctgggattccacaatatctgacacatagtaggtaataaaaaaaaaattatttatttatttatgagacagagtcttactctgtcacccaggctggagtgcagtcgctagatatcggctcactgcagcctctgcctcctaggttcgactgactctcctgcctcagcctcccgagtagctggaactacatgtgcgcaccactacgcccagctaatttttctatttttttagtagagatggggttttgccatattggccaggctggtctcgaactcctggcctcaagtgatcctcctgtctcggcctcctaaattgctgggcttacaggtctgagccaccacactcagccaaaaaaagatttttttttttaatgaataaatattgaagggcttttggaataggatgtaagaggatacaggtagtatttctggtagaagtgatctgccaggttatgagtaatacagcctttaaatcttgatagaaataagcatcctgcagaaaccacctggctggatagaagatatggctgatgctcttctagtatctggcgtaaagacaactttccagtttgtatcctgagtttgagtcacaaactgcatcaccatgaatacatctctgaatctctcttagcccttgttgattgcctataaaatggggataataatagctacctcacaggctggttgcaagaactgaattatataaggtataataactttcttcagactatgaggcttaataaaattttcatactcttaaacagtattagagacagatttccactatttaggcaactgttttctaatgatgatggtttggtgaactcttggcttgccttgatgacaatttcacctttcagaaaaagaaacacaagaactgcttctttagtcttagtatgattgtctcagaacaacttggtgctgtgaagtgaaggaaacccaaagtgtttgctgtaatgaccagagagtgtcagtgaaactccttagcctaaggataggacatgtcaaatagttcagagtagtggttctgtagcttgcaagctaaagagaaatatagattaagagagatggtagagcttaaaaaataaaattatagacacaataataagtggaaaaaatgaggggcctcaaacattaataataatatttatggagtcttttttttttttttttgagacggagttttgctcttgttgcccaggttggagtgcaatggcgcgatcttggctcactgcaacctccgcctcccgggttcaagtgattctcctgcctcagcctcccaattagctgggattataggcatgcgccaccagacccagctaatttttgtatttttagtagagacagggtttctccatgttggtcaggctgatctcaaactcgcgacctcagatgatctgcctgcttcggcctcccaaagtgctgggattacagccgtgagcaaccatgcccggccctatggagtctttttaatgtaccaggactgtgttaaaagctcaaagcctatttccccttttaactttcacaatattcctatgacatgcccttgaattagcttaattttaaagtggtcatgtgcagaagatggaaagaattttaaaatttgacacaaaactataataattaggacaaaaaagctaaaacctaattgagtcaaagttggtgattcacacataagataataaaatggatgtttttagccatgttcagaataagatatggaagatatggaagaaataagcctacctcctggaataggtaatgggagattaacaggtgatagaggtaagtaatagatggctcttttgtttctgtcttacccatcaaggggagtgttcttcaaattgtcaagaacagttaaaagaaaacaaaaatccaagctagatgaggagatagcagaaaaacgcccactctctttagtgagattaactattcaggagcagatgaattacacattgggatatttagtgaagaaagtcatagtggagccactgttagttcatttagaaatcatggagaacagaaaggtcctaaaagacaggacaggcaaatgtttccatttttataaagaagggaagggtggattctgaaaaccacaggctactgaaatttaggacagagctccagagggttatatgattattcatgtattttgggattgcccagaaaagaaatctgggattttttctaagacaaagtggatttactaagaataaatcatgccaaacttttttttttcagtaaagtttcaaagctgatagattaaaaaaacatgctgtgagcataatgtatctgacttcagaaaagaattggatgaagtcgcttattatacctttctaaataatataaaaaagaacgagctaggtaatagtaccgctaggggttgctaagtcactgtatagcaaattatctagtggtttttgacagggctctgtcttgggtattgaactgtccaacatgtcagtgacttgagcaaagacagcattttatcgtgtttgcaattcaaagctagaaaacagttgaacatgttggatactatcattcatatttacaaagtcctaccagataatacaatgggccaaaatcaatcagatgaaatttaacaagaataaatgtaaagctatcaactaggagtgaaaagcaaattgcagaagttcaggatgtgagacatctgtcctaagagttctctaatcaacaacaaatcctaatcagtgttgaggatagtgcctgacacataatggatactcaaaaatatttgccgaatgaatgaatgaacagatactgtgatgcaactgtttataaaaagctccttacattttaggtttcattagtgcatacatatggccaggttaaagaagctaagagtcccactgtactcttaattgtccaggccacatctaatactgtgtctagtcctggacacatttcacaaggacactgtcaagtcaaagattaccttgaaaagagtcaccaaaagagcacctatctggaccccgtttttttgttttgtttggttttgttttttgttttttgttttctgttttttgtttttaccacatttaagtagaaaagttaaaggaactagagaaatgaagaagccagacagaagacatgaaaaatatgaaaattgccttacaatatttgaaaaaagggctaggtgccgtggctcatgcctgtaatcccagcactttgggagtctgaggcaggagtatcacttgagcccacacattcaagaccagtctgggtaaaaaattaagaattttttttttttttttttgagacagagtctcaccctgttgcccaggctggagtgcaatggcgcgtcctcagctcactgcaacttccacctcccaggttcaagcgattctcctgcctcagcctcctgagtagctggggttacaggcaggcgccaccacacccgcctaattttttttgttgttgtcgttatccttagtagagatggggtttcaccatgttggccaggctggtctcaaactcctgaccacgtgatccacccacctcggcctcccaaagtgctgggattacaggcatgagccaccgcacccagccaaaaatacattttttaaaaaattagcctggctcgctggtacatgcctgtagttccagctactcaggaggctgtggcaggaggatcacttgagcccaggagtctgaggcagcagtgagccgtgatcatgccactgcactccagcctgggcaacagggcaagctcttgtttcaaaaaaataaaaataattaaaaataatttttaaataatatttgaaaaatgtcatttggaatgaagatcagactaaatctctgtctagctctgaagagtaaaattaggatccattggtagaagacagaggaaacagatattggctctgtattaggaaaatcttggagagtgatccaaaagtgaaatggacttctctgcaaagtaatgagttccttgttactggaaatgtgctggtagaggctgcacttttattgaaggaatttgtgaagtgagatattaagctggatgacttataatgctaatattttgtcattgtaccaaggctagagaagtttcataggcacttaagaaactgctttgcacctctttcctgtaacatgaccttgggcttctgtgcacactcactgctttgttgtctactagatagttgcatactatgatgaatctcatactttttcaaaacacaaagtcctctgcagatgtttagcataattgctgtgtttcctttcactagatagatgtgtgtgtgtgtgtgtgtgtgtgtgtgtgtgtgtgttactctgtatactttacatttattcaaattgccataagaaaactttgaaacagactgcatttatcacagctaggagtcacccagagtactttcagaaaaagcaatttgctgatttaccttttgtatgtatttccaaagcactaaagttacaaagacctagtgtatagggcatgaagatgaataagcaaaggcaaacaagaatatccatcacaagagacattaatgtcaaggaggcaatttttaaatgtacaattatttaaaaagaagaggaaagattgacaatgatggcttccatcatatgtttaaaagtgccaaagagcaaagccatttgccaaacaaagcaaagagctccagactacctttgtgagtttgctgcctgcaggccaggccactctggactcctttgcccaagcagacaaaatattatcatttccagttctttaaagctggcaccctgcttcataactttgacattcaacatatcataatatttttgactaccaggtccacttttcaaaaagcatcttttgaaaattctttctgaagatagcaatatttcaaatcttcattgcctgggcttgctttttcatctcctgccagtcactgaaatcgtatttaatcagactgggctatgtggttcctgtgtccggctggtcccaagcatggaaatgtagctcttggacagtgccataaaatcaggcaatcctgagtagctggggttacaggcaggcgccaccacgcccacctaattttttttgttattgttgttatccttagtagagatggggtttcaccatgttggccaggctggtctcaaactcctgaccaaattgtcaattacacaaagatgccaagtttagagggaaaggatttatataaccaacaaagtgttccacattttaaaaaagacataattgtgagtaataaaagtcagagtggacacactctattttatctattttttttcacttcccataagtagttgtagtggtgccctcagatactatgggatgtgggaaaatcagtaagatatagacttggcagcatgaagggacttaaggtggtgggaagattagggccagtcctgggataaggagttgaaacattatttagaatccactagggagttattgaaggatttcatttgcttgcttgctttgaggaggcaataacgatcagaacagtcctataagaagttcaatctctcagtccaaaaagtccgtgcagaaagagacctaaagtaggaaggggagtcaggaatctaacagagcagcccagaggtggagcagagtcagagacaccgtttgagatccgagcacccactgactgacagccttcagttccaatccaatctgcactgcattctgggtactaaccctgcacaataaccagctgcaattgccaagaaaacctgtgcagctggtggtgagtgaaaaccaaggatgtgaactcaatgtgctgcagctgaagaaacagagttgtacctggaaccgcccagtgggttcaccttgcccactgcctacacagaacccatttatcaagacaggggaattgcaatggagaaagggtaattcacgtagagctggctgtgtgggagaccagagttttattattactcaaatcagtctccccaagcattcagggatcagagtttttaaagataattttgcaggtaggggcttgggaagtggggagtgctgattggtcaggctggaaatgaaatcatagtgggtcaaagttaggttttcttaacgtcttctgttcctgggtgtgatggcagaaatgattgggccacattactggtctgggtggtgtcagctgatacatccagtgcagggtctgcaaaatatctcaagcactgatgttaggctttacaatagtgatgttcccccaatttggaggtatttggggagcaatttggggattgctcagactcttggagccagaggctgcatgacctctaaactgtaatttctaatcctgtagctaatttattagtcctgcaaaggcagactggtccccaggcaagaagagggtcttcgggaaagggctgttatcaattttgcttcagagtcaaagcatctactgaattccttcccaaagttagttcggcctgtgcccgggaatgaacaaggaaagcttaagtgttagaagccagatagagtcggttaggtctgatttctctcactgtcataatttcctgagttataatttggcaaagacagtttcatacccagtgactgttttcctgagtgctttccagggtggtggccaggcagaggtgtggtcgagtcgggaggtgggatggttccagcctcaggggcctggcttcttcttccttcctggagggacaaaatggtcatcttcctcctgctgtagtgttttcccctgcgttttgttccttctgctatgtgtggatgtgttgggataagatagggcaagatgagcaccgggaaagggggctggcaagaggaagggaaccctgtctgttctcttccccttcccagtgatgctgcctctggagaaggtgaggaaaactcgcacccaacaggctgcaggctcctggggccagagctttctgctttttccagactccatatgactgatgtgaaaacgttgagtttcctgagcctgcttgccctctgggtagtctaactgctctgataataaaataagtgtagaggcactgaagtaaagaatttgcaataaaaaagaaaatgaaaaatggaagccataagagaaatgagtattggatcaagtgtgaagaatgggaaatgtcaaggcacttgataatttttctgctaacaaacagacattgtgaaggtggaagtttccatggttttccttccctgcgttttcttttgctattgtcatgagatctaggggcatgagggatttgtcatttgagtgttacattgcaacaaaaagcaaggcagaagtacagaatccacttaaatgagagtatgaacacaataggaggttttgctacctggaattagatgttgaattgctgctctctaaactttattttctatataaaaagctttaaatacaatcatttaattattcatttaaagtttatattaacaacatttagtgtgcacctgctatatgtaaagtatcccactaggtactattcatcaaattaaagccagctatttagttatgaaaataaaccatggcccacataccctgtgaagccctgttaaaagcaggcaacatgcccaagaaaatatgtttcctttgaatttcacagaaatcttagtttgaggaagaaaaatcaagagtttttgttataagccactatgtgtatgctctgaaacagttaatgtagagaacagaggtagtggccataactgaaataaggagatagtgagtgagtgtgtgtgtgacctaattcaagtttggtggtccaagtggtatttttcttggcctgtaaaaactacaggtatttgcaaaactgttctaaatagtaatgtaatagaagttttttaaaaattgagttagtgcatatgtttggactcaatttctccctcttttggttactatatatggttctaatttccagctgtgcagttactattgtaaattctcaacattaaaaaaattttcagatacaaattatttttattgatac

SEQ ID NO: 244 - DNA, 10000 bp, Homo Sapien
ggttgtagataaagaggcacagctaactgcatggcagagaagattctgataattgctaaaacaaaggaacaaagcatggatacagaggagggaaaagtacctatgaccagtttaatctgggaaggcttcatgggggaaaggtggtaacatttgacctgaactttgaaatacagctagaacttgacagatggtaatagagagagcttccagacaaagagaataaccacctgaacatagttcataaggtggacatgtgcagagcatattttatgaacatcaaacagaccaggctggagtgtatagttactggaaggaacagtgagaaattaggccagaaagataggcttgagcttgaagttaaggacttaagactttatatcactattttttattatggaatgactttttcagaactatggtatagaaagatcatccaggccacagtgtaataataatagtcatcctttattgaatacctgctatattcaagcaaccattctaactgatttatatgaattaattcatttcattgtcatttcaatctatgaggtagattatgtcccattttacagatgagtaaaatgaggcacagataggctgggtgaccttcccaagtccaaactgccagaaatcaatagaaccagaattcagatcttgatttttggccccagaccccatgcccttaacacttaacactctcatagcaaagaagcagaaagcaggcaattagaagctatttcagtatccagtaacaagttctgagggctgaatggaaacagtggtttagaaagagaaagaaaacatgtatgaatgacatagtagaggcactgcccccagtttgctgtggagtggaggatggtgaaggagagcagagtcagagaagactttgtggcttgggatttgaaccacaaaaggcaaagtaaatttcaatgggaaggtgaagggttcagttttgaacatgtggaacataatacacatgtgatactatcttgcaaaatgttggaagtgtgggctggagaaagtttgcagctacagatgttgaaacattgtgggaatcattgaagccagagtaggtcaggccatcaggagaagcacaatctctttgatgccttgtaagataaactctcatcatttttctttttctggttactcaaggtataaaattcagttgttgatttgagatctttcttttttcaaatgtgaatacttatggctacagatttttctctttgcactgccttcacggcatcctataagttttggtatgttgtattttcattttcatttatctcaaggtattttctaatttctcttgtgattttgtctttaacacatatgttgtttaagagtgtgtgtttaatttccacatatttgtaactttccagttttccttctactattgatttctagttttatcttattgtggttaaaaaagatatgttgtgtgacttcaataattttaaatctgttatgtcttgtttaaatctgttatgacctgaaaaatgttccaggtaacacttgagaaaatatgtaccctgctggtgttgagtgaagcatcctgcatatgtatgttaggtataattggtttgtagttgttgaagttctctatttccttattgatcttctgtctggttgtcttatcaatttttgaaagtagggtattgaaaccttctattattgtaggcatgtgtacttctcccttcgagtctgtcaatgtttgcttcatatattttggagctctgatatctgatgcatacatgtttatatttgctatatcttcttggtaaattaactctttaatcaatatataataaccttctttgtctcctgtaaagtttttaatagtatgttgtctggtattagtatagccattcttaacggttttttgctgatatttgcgtagagtattttttactatccattttctttcaacctatgtgtgtctttagatctaaagtgagtgtcttataggcagcatataattggattatgctttttacaaaatacattatggcaacctgtgccttttgtttgggaagtttaaaccatttacattgaaagtaattagtaatagggaagaactttcttgtgccattttgttatttttctgtaagtcttatagcttttttgttgcttatttcctccattcattatttgggtttagttgattttcttgtagtgacaagttttgatttccttctattttccttttgtgtatattctatacatattttctttggggttacatggggattacatatagtatcctaaaattataacattctattttgaattgataccaaatttacttcaattgcatacaaaaactatacttctttgaaactactcccaatactttatgttattcaggtcacaaattatatatatagtgtacaccttaacatagatttatagttatttgtatgcactggttttttaaataccatagaaaataaaaagtggggttgtaaaccagaattacaatgccagactttacatttgtccatatctttacttttaccagagatcttcatatcttctttgagttactttatagcatcctttcttttcaacctgaagaactcacgttagcatttctcgtagggcagaactagaagtaatgcattttctcagttttcgttttgtctttatttctccctcatttttgaaggacagttttgctagatacagttgtgtgtgtgtgtgtgtgtgtgtgtgtgtgtgtgtgtgagtgtgtgttttattttgggactttaaatattgtacaattgccttctggtctctaaggcttctgatgagaaactaatcttactgaggatctactatatatgatgaataacttttctcttgctctttcaagattttctttgttttagcctttcagcagtttgtcttcaatgtgtctcagcatgggtctttttggttttatcctacttgaaattcattgagattcttgaatttgtagactcatgtcgttcctcaaatttggtaagttttcagccattatttcttcacataagctctcttaccctttctctcttctctttctgggactttcacagtcatatattgatcctcttgatagtatctctaaatcccttaggctctgttcacttttctttattcttttttctttctgctcttcagacttgataatttcaaatgtcctattttcaagtttactgatactttcttctacctattcaagtctgctactgaaaccttctaatttatttttcatttcagtttttgtatttttcagctccatcatttgtttggctgattttataatttctatctttttgttgatacatttattttgttcatatattgttttcctgattttctttcattctttttttctttttttttgagacagggtcttattctgttgcccatgctggaatgcagtggcaggatcatggctcactgaagccttgatttttctaggctcaagcaatcctcccacttcagcctcctgagtagctgggactacaggcacatgccaccatgcagagctaattttttttttttttttttaacagagacaggggtctcgccatattgcccaggctgagctcaagcgatcctccttactacagcctcccaaagtgctaggattacaggcataagccactgtgcccagcctcccttcattctttatctatgtttttctttagctctttgagcatatttaagagagttgttttaaattctttgtcatatgtctgatccttgtgtttcttcagggatagtttctgtctttttattttatttctttgaatgggctatgttttctgatttttttgtgtaccttgtgatgttttgttgaaaattgagcgtttgaaaaacaaacaaaaaaacaaacaaaaaacccataaacttctcccagtcttcacaggctggctttgtgccacggccatcctcatctaattagccaggcttgtgttctgagcctttggatctgtctgaggagaaaggttaaggtctcctcaggtcttttctgagcgtgcatcttgcccggatgtgcatggcatttctatcaccccatatacacagctgtttatacatgtcttaattccccagagtcttacctcagtttctccttagggacttaaattgtctactctccatttccatctgtcagcccaggtatctacaagtcttagtctctctgcagctttcccaagcagtgcctgctacttctcactgcctcagctctgagttaggtgcaagagaccaatcttcaggaagccctcagataagttaggacattgtgaataaggtccactctgctccctccaattcaagtaatgggattgagaactgccatctccttcagaccaagatggtggcatgtcagaggaaggagggaaagggtgagtaaaaataccacaaaattttctaccattttaaaattgacttatttttgattgggcattttcttgactgctgtagacctttgactgtttttcatagctcatataagaatactttatcctgtttttgtttttttgtttgtttggttgtttttttgttgttgttatgtctctgtgagggaacaaggcttgatactccccagtgtaccattttgctgatgtcactctccattatcatttttgtgactccttctggctgctggatacccttaacagaccaaaacgaaggcagacaagagagtcaaaaactatgtctcttttcatgtgccataacagatgaatttttcctgtgaacagtgtctatgctactcaggaatgacaagctataaagaatgagcatatataaacagaggccttggaaagccccaactctttaaatcttaaccgctattccaaaacatcaaacaaccctatccttgtataaccctaatgtgaactttgattttgccatggttgaggtgattttgccatggttgatcccaaagcgtatcctgttctggataggcagctgtgaaaatactaactttcttagctcgggttcccctgaaagcaaagtcgtttatctgggaggtgattccaagttgcagaaatgagggatgaaagagaatgagaaacagaagaagaagaggccaatataagaatgatgcactgatgctgctgccatgcacattgagagctaaattttgctgatattcctgagaagcatacagaatcatcaacccccaggaattgcccacagaacagatgggaagccagagtatttattaactgtcaagggtttcccttggggaaattaactccttctctgattttcctctgagctgcacatgtacctggacctgtctctgaggtattacactgcaggtggggcagtagtggagtctgccactggtcaagggtgtgtgggagctggctaaagtgatactccgtggcaactggggatgctgatgtgtgttgggaagagtcaagatgtccatagaatggcagtcaggtgacagcctcataagtatagatgaggtgctctaccaaacagaactcaacagtgtaaatgtagaatctcatcttttctttttctcctatttcccttctctactttttccttgtcaaatttcatctatttataaagaatagtcacgccataataatatagaactgaattccatgcttttccaagccactgcagttacacaagttggccccccaccaccttgttttcttagcttcccagtggttattaaccagagatatatatttcaatcccacagagcagtccttagtatattcttgggcttttcagggtaaccttctatatgttgaggaagcaagaactcaaggttttccaaaaagctgtgggtccaagtggttaatctgcactggtttgcattagtttacgtgtgggaaatgcaacacaaaggaagtgcccagcaaccctgcacataacgtgcaaccattcattctgactcttttccctgaggatttctcttggctgaacagcaagctctctgggctctgcaactagagaacatctctaacataacataaacgttgggcagctgctgggagctggagagggctcagtctgaacagctgtgtgaggtttgaccttggggaaaacaacaccaaatcccaccaccataggctggtttccatttggacttagtgcaaatgaggcataataacaattaagcagatatacttggaagggaaggaaattaaaaaggcattttatgtggggtaagaagagtgggtaaagagaagaaatttcatggatgatagctgagggaagcttttctggaactgatagaggtaaaaactattatgggttgttagctgtatgagagtaggaactttcacttttcctttatgtgattctgtactgtttaagtacacttgcttattacaaacatgcccgattttctaacccatccccctagaacacagagagaccctgcaattgtagaagtgtagacatgtgaaaggagaggggttgaggggtgaagctgtgttttaagacagccacaggcactgattagacagactgggatgcttctttgagtgggatactcactggtaaacatcttggctaaaagatgtcctgggaaagattatatgaggacttggggctttaaatcttgggagaagacttttgtaagatcacttgaaattccctaggaattgcttacagcgctatcataaaaggaacaaaaaaatccatgtgaaaatattaatcataggaggctggaaaggcaaagacatttgtggctgtggacaatttcaaataaattttgttgccttccttaaacaatgccagctgtgtgcctgctttctcaaaccaagatgaactgtaagagaagaaaggggaggaaaagtccctcccgcatacagacttcaagtgtgtctgaattaaggcggctaaattctattattttcatgttcctcaaatcactattgcagggtggagctcataaaggcataataaatgtttgttcaactaaatatttcaatgacccaaactctatgtggattaagaaaattaaaattatgttcaattttcctattgaatttgaaggctgagactttactaagctttcccattgtgtttttaagtggtttcttaaacaagttgacccaaaggcttgggtcattcaacgaatgtgtttgcttcatggcatagcttagcgtgagctttgctgtcagatgtgagttctggctccaccatttactagttattcgactgggaaaatggtttagcctatgtaaaagctaagtttcttcagttataaagtgggtttaataactgtacctaatctatggaagtttggtgattaagtgagataatacttatagaatacctacctcagtatttttcacagagaaagcaatgaacgtgagttgtagttggtcatcaatatcctcctcctcttctccttcattatctagaagaggggtgggtaaactagggcccactgctagtttttgtaaataagttttattggaacacagccatgtccatttgtttatgtattttctacagtggctttcattctacagggcagagttgagtagttgtgatagagaccatatgacccgcaaagcctaaaatatttactatctggtcctttacagaaaaagtctgctgatccttattctagaaggaagaaaatctagggatgtgtttgtgcgtttcctgagcttaaattaccaggaactcatagctttgattagaagaaactagatgaagggtttgaataaacccttaaagcatgaaacattatgttttcttcatagatttaaaaaatatgcctagaggcagagatgctcacatgctaagacagacatggggaatctttaaacctaaacattttacctgaagagaaagaacagttagaatctttcggcttaatagaaaagtcacagaagcaagcagagaaatcctaatgagttagaggacaatcatttccaaggattttgagtgtgtcttaagttattttattgaaataaaaattccttttctgagttcagaggcataatctggagaaggtcagagagcacttatagccaggaagtgtttgcacataataacagatatgctatttgttcccaggaattttttttctttaaacctcagagttaacatagtcaaatacagagcaagtggaattcctgctctgtatttctaaaattgtctttttagactcatagtagagaaaacaatctgaaaaaaaccacttggaagaaagagtgactacagttgatgacaacagattgaaaagagaattaaaaagggtcaaaaaacccacaaggctttcaagattagataaaaactgctctgggcagatgagctagagagggtaagaaagagagaggagctgcctaaagagaagggttggtatggctcaacatgaggccaggggaaccgtaaggacagggttagtgatagcattagaagttggctggcctcaggccacaagcaccacccttcactggggctttgtgagccacacgagagttgagtgagggtcccaccaccatttcccgaacacatgacatgtgtctcttggcctaaggggctatgttagatgatcttgtccagaaggaatgatggacggccctttgtgcccttaaactttgctcatctcttttcaaactaccacatataattctcacgttaggggctaagggtgtgtgtgcataaacagagagtgggacctgggctactgcagggttgaagtaaggtagaaataacagttcccagtgtctgtcctggggctggaagacagtgcagggttgatgttagctgtagatctcccccaaaccaagactgtggtgggatccaccctgtggaacatagtaatggttaggaggatgttaagaaattgatatgcagaagttcccaagcatttctcatttgcctcttagcttgtcctaaggtgtataacagtgatcatgtaaagcactggaaatactgcttgcagggcaagtgctcaatgcatgatcgctagttgtttttttttcagggaaacagaacaaatatgttagatatagatatatacaaggggggatttaccacgggaattggctcacacaattctgaaggctgaggagtcccatgatagccttgtctgtaggttggagaaccagagaagctggtggtatgattcaatctgagttcaaaggtcagagaaccctggtgggggatgaaaagaggaggtgctgatacaattcctagagttcaaaggctcaagaacttggagttctgatattcaagggcagagaagatggatgtaccagcccccaaagagagggaaaattcacccttcctctaccattttgttgtcctcagtggactggatgatacctacccaacactggtaaaggcagattttctttatttagcctattgactcaaatgctaatctcttccagagacaccctcacagacatatttagaaataatgtttcaccagctatctgggcatcccttagctcagtcaggttgacaagtaaattaacaaacacattgttattatttttacggttgaaaccaaactgaaaactttgttttttgctgtttagcaaataaattctatttgttttttaaaaacaaacaaccaaaaagcacctaacctgagaagtcagcacagctttcagatcctcacccctagaaagctcttgtcctggctgctccctcctccttgctctgtgagaaattccttatgcagctacgtgcaggaactgactgcgcgggatgatccgtgagctgcatgtggactaccccaatctgctttttgttcctaattcctgaatgagcaactgaaaattccccatgtgatcactccctctaccagctcttgctttcccagaaacactaggcttgctgttttgtacatttgcaggataaaagaaatgtaaacatttaaataataatgtatttttaaaggcataacggggttagttaagtaaaacaacccatctcacatcatctgcagaagaaatctaataagttttggggttcattggggaaccagagaatattcaattttatgacaggattaagtttt

SEQ ID NO: 245 - DNA, 10000 bp, Homo Sapien
cctgatctggtgatctgcccatctcagcctcccaaagtgctggaattacaggcatgagccaacatgcctggccgtatttggggatttttaaactatctttctgttattgatttctagcttacttctattgtggtctgagagcatacattgtatgatttatattttttaaaaaattttaaggtatgttttatggccacagtgtgaatgttctatgtgagcttgagaagaatgtgtattctgctcttgtttggtgaagtgttctaaaggtgtcaattatattgaggtgattgatggtgtttttgagttcaactatgtccttactcattttctaataaaaaatcaatataaatattttctaatataaaatagtgttgaagtctctgattagaatagtggattcctctgtttctctaccccattattccattggtttttgcctcacatattttgatgctctgttgttaagcacgtacatattacggatagttatatcttggaattaaggattattattgacacctttatcattaggtaatgcccctctttcttactgataattttccttgctatgaagtctgtcctgtcccaaattaatacagctacttcagctttcttttaattagcattagcatggtatgtcttttctccatccctttacttttaatcatatatgtctttatatttaaaaatgggtttgttttagacagcatactgttgggttttgttttttgatccattctaacaatctctatctttaagctggtgcatttagaccatcaccatttaaagttattattgatatagttggattaatatctaccatatttcttactgttttctagttattgctcttgtttttcgttccttttttgtctcccactcttttttcatcttttgtggttttaactgagcattttatgattccattttctctcctttttagtatatcggttatactttttttttttttttttacttctttcagtggttgccctagagtttgcaatatacatttacaactaatccaagtctactttcaaataacactatactgcttcatgggtattgcaagttctttgaaataaccaagtacagttgacccttgaacaacatgggtttgaactgcatggatccacatatatgtagaattcacaagatgcaatatccaagtattatgaagggccaacttttcttttcatgtagaggatcctacagggctgacagtgggacttgcgtatgccaggattttggtatatgtgcagggtcttggaatcaatccctggcatataccaaggggtgaccgtatcgctaattcctccctcgcatcctttgtatcaatgctgtcattcatttcacttacacataaagtataaacattgaagacattgttgctattattattttgaacgaacatttatctgttagatcttatttcttctctaatgcttttcctttctttatgtagatccgagtttctgacctatataattttccttcttggtgaagagcttcttttaacatttcttgcaaggcaggactactggcaacatattctcttcatttttgtttgtcttgagaaagtctttattttttcttcatttttgaaggataatttagcaagatatagaattccgtgttgctgttttctcacccaacagtaaatattttactccagtcttttcttgcttgcaaggtttctgtgaggaagtgagatttaattcttatctttgttccactatagataagttgtttcccccccaaccatggcttctttcaggatttttgttatctttcattttctacagtttgaatataatatacacaggtatttttttatgtctgacactaatttttggaaattctcagtcattactttctccaatatttattatgttgctttctctatttcttgttctagtattccttttacacaagttacatctttcatagtttcccccacagttcttgcatattctgttcttcttttctcagtctttttttatttttgcttttcagttgagaaagaactgaaaaaacagttctattgacataccctcaagctcagattctaatgtcagctgtgtctagtctactaatgagcccacaaaaggcgttcgtcatttctgttataatgttttttatctctagcatttattttttattattagaatttctgtctatctgctttcattacccatctgttcttgcatgttgtgtaccttgttcatttgtgctcttagcttgttaatcatggttgttttaaattcccgatctaataattccaatatccctgccatatctgagtgtggttctggtacttgctctgtcttttcaaactgttttctaccttgaagtatgctttgtaatttttttgttgaaaatggatggaagaaactgataaataagctttagtaatgtagtgatgaggtatgaggtgaggggaggtattctatagacctatgagtagaattaggtctcagtcttttagtgagcctgcgccccttggctgtgaacttcacaagtgcttctgaggcttttttcacctctttaagtagggtcagcatagctggagggagctggggttgggtatttccctttctccagctagaccaggctctgataaaacctcagcagggctgcctgtggttaaatagttgttcctgacggcagactgccttaagaacagaatgctctgtctatttcaaaatggttctttgtctgctccccctactggaagcatgagattcttctcacattttctctgtgaggacctggtggagcccctggagtaaaactaagtatgcttctctaagagtgggctcccctggaattctcaacactcaaacttatccacacggagcctccggcaatttaccaattatggctcagggttttctacccaaatactggttcctgtggagatttctgctcatgggttactactctggtaagttgggattctctgtaattgcttctttaactctccagttggaaggcagtggtttgccctgtaatcttagttctctgacagatgaagaagagttgttgcttttcattttttccattttttactttttgttagaatgtagtgatgactttcaacctcctgaagtgccagaccccaaactaaaagtccctctagtctctcttgctctttaaatcagagctgaggttttctaccctttgtttcccctctgtgctgatacctgttccactgagctcccattgatcaccatcaaaagatcaacggtcattatcacacagacatgcaaacatccttctcatgcttccatcttattacagatacatgagtctgctgtaattctgagatgaaaatgacatatgccacccactaaaagctgaagctcaatctgggtccagctgcagaggagcagtcctctcttcaattcccaacagtcctgcccatcataactacactcaggagttcccatctgacaaataagttgtccttatcttcccttgcagtgtccctgaatggtgtgtgatgtaccttctgatgcagtctgcatttctgcactgcttttctttgctctctttgccttcttttgttctgttgaataaaggagattgagaatatgaactttctgttagattgccttgctgaccatgtgctggtttagaaacattctcatcccacaaacattcctcatctttgaggaactgcccctctccacaccgacaactcaccatgctccacaccctactctgtcagtcagtgattctggaggacactctgggtggacgatcaccaatgttgtataagccccaaaagctgttaggacaagttcccggtgtgccaggcaaagtctgttctctttccccagctgaaaagctccaggacagcaggctactggcaggatacctcgccagcctcgagtaaaggccagacccttacccagatctgagagaccaactagatgccagttggcttgagacttggagcaggcattgccatcccagtcacttgtgaatagggttgttcagacaaaatagagaatgcccagttaaatttaaatttcagataaacaacaaaaaatatacagtaagtatgttccacatgttgcatggaacatacttatactaaaaaaaattatttattgtttctctgaaattcaatctgaacggcacatcctgtatttttgtttgctaaatctggcaaccctgcctatgaagtcatcctgcctttatatggaatcacagacaagggcacaggttgtttactgggctactgctttggatttctcctgtaaggggcagacaatagacaaggaccaagcttaagacccttcctccaaatcatccgcattaactaacccataggttgcttagaagtcttgttcagtttctaaatatttttgaattgttgagatatatttcattactgctttctaatttaatatgccatgatcgtggaacatagtcagtatgttttcaatattttgaagtgtattgagactgttttatggcttagcatattacttatctttgtgaatgtcctttgtgagaagaatgctgttgtgggtactgttttgtagttctttgtatattctgaatacaatttcacatatatataaaaattatgtatatatataatatttatatatattcaaaattttgcggggttgtggcttactgttttgctctcttcatgttgttttatgaacaaagtttatcaattttttaaggtaagcttttttctatcccatttaagaaatttttgcctatcctcactccataaagatatcttctgttttcttctgaatgaattattgttttacctttcacatacaggactataatacaactgaaaatgatttttatctatgggatgaagtagaaatcgtaatacatttttcccatatagacagccaactaaccttgcaccatttattgaaaagactatcctttttctattgcactgtaatagtacctttgttgtaaatcaattgagtcaatatgtagtttgcttctagattctatatactatctcataggtccatttgtcaatcatttccccagcaccatactttcttaattactacaactttataataagtttcagtatctggaactataagtcttccaactttattcatcattttttaaaatttaatttgatactaagttccgggatacatgtgcaggatctgccagtttgttacataagtaaacatgtgccgtggtggtttactgcatctatcaacccatcacctaggttttaagccccgcatgcattagctgtttatcctgatgctctcccttcccccaacccctttgataggccccagcatgtgttgttcccctccctgtctccatgtgttctcactgttcagctcccacttataagtgggaacatgtggtgtttggttttctgttcgtgcattagtttgctaaggataatggcttccagctccatccatgtccctgcaaaggacatgatttcgtttctttttatggctccatagtattctgtggtgtatacgtatcacattttctttttccagtctatcattgatgggcatttgtgttggtttcatgtctttgctattgtgaatagtgctgcagtaaacatacacatgcatgtatctttataatagaataatttctattcctttgggtatatacccagtaatgggattcctgggtcaaatggtatttttggttctagattttgaagactcatcacactgtcttccacaatggttgaactaatttacattcccaccaacagtgtaaaagctgttcttcttttttagggttgttttgactattttagctccttttcatttcctgtcttagttcattttgtgctgctataatggaatagctgagtctgggtagtttaaaaaaccaaaaatttatttctcacagttccggaggctgggaagtccaggatcaagatactgacaggtttggttgtctaatgggggctacattctttggaggggaggaatgctatctcctcaactggcagaagagtagaagagcaacctaactgaatcctgtgtgaagcttctgaactctgaaagtccccatttctaaatatcattacattggcaacatccaaattttggaggcaatacattcaaatcatagcatttcaacacaaattttagaatagatttatcaatttccacaaaaaatctgtgaaaatttgattgaaattgcattaaacccatagttcaatttggagaaattgatgtatttacaatattaagttttccaatccatgaagatatcatatacctttgtttattaggtcttctttaatattttcaaaaggatcattttagttttttgtcttacacatctttggttaagtttatttctaggtattagattttttatgctactaaaaatatctttcaaattttgttttctaactgttgttttctagtgtacaaaagtataattgatatttgtatattgattttctggtgaccttgatacattcacttattaattctagtagtttgtagattattttaattttctatatatacaattatgtcatatgtgatcgcctgcagtttgcttttcttctgatccagaagatgcttatttctttgtcttgccttattgcaatggctaagatctccagtataaagttgagtaatcattgtgataatagttatccttaccccctttttgttcaatggaaaagtttcatttactattaagtataatattttttgtttttttgggcggccatttgatttatctccctttattctattcattttgtatattacatgattttttaaacattaaaccatcttgactgcactgatgcttgactgctgacaacttctaagcaagccccttgcctccctttcctattatgctcattatctggaaaaactgatatgaaaaccgaggtgttccttcctttggcagtgatagcaacttccaacttcaaaccacatgcaggccccacccctaattaccataaaaaacctgatgctataaaaaaccctgctcactcaagccacttttggaccagcttggaagtcctgccttgctttcctcagaaagccttattatttgagttaaatatccgttcaccccctcttggagtgtgtggtgtgtgtgtgtgtgtgtgtgtgtgtgtgtgtgtgtgtgtgtgtgatgtcatcagtctcaacagctaaacgaaattttgtgtggctgtccatcttgcctctggaaggtggtcatgacaatcagcactgtgagcctgctagatgtctagatgatgactgcttccaccggagtcttttctttcttgctttggcttccagtctggctctgctgtcttgctctgggttgctgtgtgctgactagggggctctttgagttgtgttgctgcctgctggcaaacttgccctttgagctgtgttgctttgggctgcatttgctgagttctgctgagcctctgttacagatttaattgacccaagtcagaagtttcaaaaactgggatttaaggacaggagtatgggattgggggccctcttagggaggccctgaatcgtgttcctcagcccagacctgtctgtatataccgtattgaattgtatttcttgattccagcataaactgggactgatgctaagctaaggggaatggctcttaccccgtgactactggttgtgtgtctcaagcgggtgccggccctcattctacggagttttcagggaaaagactgatatgtggtcccttctggtggtcactcatgtggaagaagagcagttactacgtggcatgctgaagccacgctcctaaaaacagatggcagccaggcgcggtggctcacgcctgtaatcccagcactttgggagcccacggcaggtggatcacctgaggtcagtaatttgagaccagcctgaccaacatggagaaaccccgtctctactaaaaacacaaaattagccgggcatggtggcgcatgcctttaatcccagctcctgggaaggctgaggcaggagaatcacttgaacctgggaggaggaggttgtggtgagccaagcttgcgccattactctccagcctgggcaacaatagcaaaactctgtaggaaaaaaaaaaaaaacaaaaaaccagagtgcttactaactagagtcctgtaaaatgtcttggctgctgttgctgctgttgctcctgttgccaccgctgccgctgcctatgcctctgttaccagaaaagatcctcatcctccgggttataggagaaaacacacatggcacagccaaagggttaattcaactatttccatgggggaggcctcgagccctgacaatacagatttgagactccttggaggaataaatatataaatatgggcagagtagagagaattcctctcctgccaaattatattcagaaaccacaagaaagatagagagagagagagaaacctgaaaacagggagaagaaacaaaaaattaaaacaaagatccataatttgatacaattggaaatccaaaattggctaaaataatttatacatctaaaagataaaaaggtgtgcaggctgtcttggtgtctccaccacataaattctgaatttactttcacatttgctgacatacaataattgacaattcttcatggtcttaatccatactgaagctcaaataatacttatacctggggatcctattaaatttaaacaaggtacccctgtaatcttggggaagttaatgaacaaaaaatagagaacaaacaggcatgcctcactttaattagcagaactactgacttgcttaaatttcccacgatcatagcatcctctaacgtttcccacaatgggcatggacagtctaacccaataagtcataaattaaaattaaatcaagtccttggcatttataaattggtttggcaaaatgggacaccatgggcctccccaagccctagttaaaatagttaatatgccccagtgtaaattaaaacaggacctttaaggagtgaagcccattaaacaggatctatttagagaagggttgtttatatccattatttttccatcaacaacctaatttggcctatttttaaacttgggaaaaatgaatggtgcctcacagtggattaccacaaccataatgtcatggtcatgcctactaaggctccatacccaatattactgaaattattgacttatccaattggcagctggtagatatttccttcttatggatttggctgtcaaatattctgttgaatgcccgttgcaacagcttctcagtcacaactcgcttcaccaccaaggcggcatgacacagctttcccagatactcagggattgcctcagcagccctgccatgacatgcaatttttgcagtcaagctcttaaatgcatctgactttctccaggagtacagatatgatttacattgctgaatcctcctccaaagagatgcatttgatacacgcgttcaggacatatagataccaaggagctcagaaaaaaagggtttgccgttgtcccacaggtcatgcaaagtcctgccacattaaatttcagaaattatttggtaaaccaagagctactccatccctgacactgtcaaaaaatagctattgagcatcttagcgcccacaatattacaataggaccaacatcttttaggtcttttgaggtcctgaaggcaacatattcttcatttacaaactttacttaagcccaaatatgctgctacttgcaaatcatctcaccttgcatagggccctctttaacaaaaggctctaaaatctgtctaaattgtagtacaatgcacatgcccgttaatgccctccagagactccttcattgcagagactttataatctctgtgcttcttggagtctctgggccacccccaatagccactttcccttaaatgttatcccattctccctgtgaatcatcaaaagaaccaatcacatctgggtagactgaccctcatggtatctctaggctgattgtaaacctagaaaaaaaaaacaattctgcacacca

SEQ ID NO: 246 - DNA, 10000 bp, Homo Sapien
caactcttaagaccatcaccgtgggatttaagtttcaacatatgaattttgaaggacacatacattcaaaccgtgtcagaattgtaaaaccaagataaggtggcctcaagtatgggccacattttaaaattgcatgtatgttatatccacgaggtccagcagcattataggaagaagcaaaggaatcaagctattacattattgaaagcaagaggtagcatttcatacgcttagaggttcacctaaaaaccaaagcatcatacataaaggcgtctggttatgtgaggtgaggctgaagtttgatttcaccatgtctgcttctggggccttccatccacatgaacagggtgccaaaaactccaaaagaaggcaagtgaaaaacaattgggcagagccttatctccaatcagttgtggagaagatgagaccaaagagatcattttctctggatgcctctctacacttccttaagatttaggtcatcaaagccttagagctccttgtagcatctactaagaaatcctttgtgtgtgtgtttgtctgtgtgtgtgtgtgtgtgtgtgtgtgtgtgtgtgccaacgttaagaaatacttaagtgaaaattgtataaggtaggtccgtgagagatcgtatcagtcattgaatattttaaatagagggaatttaatgcagggaataggctcacaggggctggatgagctgagaagccaaataggggtcaaggaggtaacccagagattgcagcagcaggaaaccactatctcttgtgcggctggagatagaaagaagggatggcactcttagatccagagaacagtcaccttgaagaagctgaaaccactgcaaacctggagccagggaggaaacacagcctgtgccagagatgccagccaaggcagagaggaaggagggatacctcctccttctctcctcctgccctccagtctcctgccagggtcctcatggctggaccgtcagagcccagctgacaagggagtttgggaaatacagtctgcaggagttggccatgtgatacagtgaagatgggaaacagggaagaaaggtgagctggcaaacagccccaggactgacatggtatcattatttcatcttgtttagcacagtttcactaatttgaggtttccgtagattattactccatcatttcctccattgtcaggctcttcctttctttgcttttttttccttctacttctgttcatttcatgatttcttggctaatgaggaagcaaaatcctagttttctgggacacaggctcacttctctgtttctagagagaaccagcttgtcttaaactagagaatggattagaggtagaaagggtgagagtgtcctccgctccatggaacctgcgctcacccactgattaggtgtatatcatatcaggaggtgaatgtagacaatgaaccagggcaggtgaggaaggaaaacagattaagcagaggtgactcactaaaaactgttaagatgagactggccttcccattggccgctccttctctaagtatcaggtgtcctgtgctcttctctactctatagcccccacgatcccacaacagaaactctgtttctaccaaacaggcatgcaagcagacacaagcagtatctatgcctcgagcaaagaccacgagccgcttataccatcctgcgggtctagttgagtattcctctcccagaggtacttgcatttaaaattttatctcaagttatgcaatgaaatgcctctatgaaggaaataatatgtgtaggaagtctatttcacctctcaaagcatatcagatgctggtctgctattctgcagggcaggccctggttctgaagggggtcagctaagactgggaggacagacagagtgagagggaggctagtgtggactactggggagccgagagtcagacagcctggagagctgtgcccggtgctcaaaaccacacatttgtcatggttaatgttaggtgtcaacttggctggattaagcagatgcccagatagctggtaaagcatgacttctggtgtgtctgtgaatgtgattccagtagagattgccatttgaatcagtgaaccaagtaaggaagatctgtccccacccagtgtgggcgggaatcatccaatcagctgagggttcagataaaacaaaaaggtggaggcagaaggcaaatctgtactgtctctctcttgtgaagctgggacacccttcctctcctacctttggacatcagaactccagttctgtagcctctggattccagaattgcattagcagccatttgtgtcctcaggccttcaacctgagagtaataacattcgcttccctggttctgaggccttggacttggactaaaccatgccacaggactccctggttctccagcatgcagacagcttatggtaggacttctcagcctatataatcataaaagccagtcccctgataaatcatctatctatttatctgtctatctatctatctatctatctatctatctatctatctatctatctatctatcatctagctatctgatttatctgtctgtctacctaatctatgtatcctattggcaccctactctctctggcctcttgggttgtaagtcacatctcttaacatctgaaaatcttggtggagtagattttctgcattggataagaaaatgaggctagtaaagccccttaatgagatttatcagatgcggttagagggagagtggttagaaaccataccacttaaagctgcccagttagctgagtctatcctgcagaatcagggtgggctcagcgccaaggaaggcagagggaaagaagtaaggaagactaagtgataaggttatataaataaaaatagaagggaaaacattgccttatccaaaaagaacacatttacattttgatttcatgtaatatacctcctgatccacaaagagaattccctaacctccccatgctatgtgataccaggcaaggctaatccctgagccctggtcagaacagcactcagaaaaacatctgtatggatttgctggctttccttaacaggaggggcggctcaaccccttcagggccttgtgaagctaaattgctatcaggctgtgcggggaaatgcaagaaggttcttcctctgttacaaatgggctctgttcttccagactagggctgcagagtattggctgaggataagagcagctcaggttaggagtgaggacttcagtgcagaagatcttaaactggactctgctctagagagagaatccatgaagcaccaaggacctgtcccactcttggatgcccccacaggaaagtggcctgggcagttttttttgctgacagtggatatgcggggaagagagtcagtgaggccaaccctattgtctgggtcatagttgggtcaagaaacaaattttgctcaacaggaacaacaaggaagtaatgacataaaccaatcaaattctctctcggggagggagaatgtgtgatgtgcctagaaaggagggcccatcaggcttagactctgccggaaacttcaatgggtcctttttccagctcccagtgcagtgtgcagcatgtccccggcgtgggaaggctgaatcctagtgggctgtccagatgctcggaggctttctcagctgctccagtgccccatgtatctggacaatgaccctcggccccagagctaatctgggcatggagcgttcttgcgattccaagtccactaataggattgtaaaaaattttccactgtgaggtgatgattagctactgttgcttctcatgatcaccctccctcctccatgcatatatgcctagcttgttaatgatctataagtcttctaaaatgacatcttagctcaagcatcttaaaagttttctgaaatctaatgactataagggactagagcagagtctctgcagaacatttgaggtcatcctctccaatcagtggcatttttcagaggacctgcgccttccttacatggacccccgaagctgtaggtacctggccctgagtgaggggcagagcaagtttctccctgagccttacatcacccacccgccccccgccccatggcagtgagcaggagggtgtgacattctgagggcataggtgcttgtcatcttgacctaagtttgccttgatatgacttagctacacgtgctttggaaaaaaacaaaaacaaaaacaagccaacctggtgagaaagcctgagatgggattgcttctcggccttttggataagtcaggcggagaaagcccgtggtgggaactggagcaattcactctggggacttgtctggtgaggtctgttgctggctcctgtgcgggtggaccctggagcgctgctccctgcctgcttaatcctacttccatcactgaggaaaacaaacattttggccatatttacgcagcatttgaatcacattttaagtcataatgccaggtcatatgactagaagactagtgatagcaaagaaagaagcacaaagagtagattacaggtgtggccatgagatgggctcctgaaggtcatttcatccacccccatgtttctacctgtcctaagatttccagaaagagggaaggactggaaggaggcacattgtttttaagtgtcaattttttaaacggagaatctaattttctggaagtattattggttagactttaaaggaaggatttatgttcctatgaattgtgtagaaaggaattttaataacagagaggcagtgtgaggcaacatgggctgagatcgtaattcagggacgaaaagactttccaggagggattagcaggcactgcaaactccgttaccagaaagcacttctatgtactggagttctgcagtgaatacacttacaggcatttattcacacagttaataaataacccatcgcttgcccttgcatcgataataaccgagatctgaatgctaggaatccacaccttgctggctgcaatttgattatgtggagcagggtttctccacttgaacctccgcactagtaatattttgagctgggtcatccattgttggggtgggagcaaggctgctgtcttgcacactatacaatgtttaacagcatccctggtcactctcgttagagtattaaccactggtactcctcctccatagttgtgaaaaccaaaatgtttcccaacattgccaaatgtcccctcagggacaagtccctctcctccccccatgttgagaaccactcatgtagaggaatgacatctttttctccgatgtttcccaacaattaagttagctcttcggggagttgcagaggggcagacgacgtcattcccaataatgctgattcccagcaggctgatgggagtgggacgtgctgaccacgtgcctgcctgagttaatgattccagtctggacaggaggagtggaaggtcactatggcagcagtcagtttcactcccatcgcaagcacctgggtttcccatgaacagccctgatcaagtgctgagtgggccagatcctgctgaggctgagaaaatatgaattctggattcaaaacattaacacaactcattggcaacaggcagtggctagaacagagatgaataattacaccacctccctagaagaaccctcttatttttacaggaaagaaagctctgtgtgctgaagcagaggaatggagaaatgttgtccacataaaaaaaaatgctccccaaacatgtgacattaccccaagggctctgaacagaggcacagaacatcaaacacagaaaaacaaaaacctcttggctctatagacatagtggatgcttgctctacatttgaaaaaaaaaatgtatctgtggtcagcaacatctgagtgctgttggatgaggtaaccctggggttgccatggacacatatttcctagtggtgcctgcatcatgaaactgcatgaagttgcttctcatctgcagctgaatgcctcaatattgagggaagagagtcatttgcaaaccaagacataccacaaaagagaacaaacctgttgcaacagggagactctccaagccctttccatcaacagatttcaaagatcagtttggacccaaggagactgatgtggggacagcagtagtttctgagcatgcagcaaaggtgagacagaggcagagtagaatcaaatatgcatgaaacaggcatgcaagtctccaccatgctagcagcccacatccaaagaggcatctgttttgagcacccctcttttgacgtggaagctggcccctatgctctgtcttgcattttgtattcacaaaagaggaaacatttctatagccacaatggactagaaaacacttaaaaaatccacatccttgtcaacacttaatattttccattttcttaaatcatagccatcccagtaggtataaagaggaatctcaggccaggtgcggtggctcatgcctgtaatcccagcactttgggaggccgaggcgggcggatcatgatgtcaagagatccagaacatcctggccaacatggtgaaaccctgtctactaaaaatacaaaaaattagctggacttggtggtgcgcgtctgtagtcccagctacttgggagactgaggcaggagaatcacttgaacccgggaggtggaggttgcagtgagccgagatcacaccactgcactccagtctggcgacagaccaagacgccatctcaaaaaaaaaaaaaaaaaaaaaaaaaaaaagaagaatgtcattgtggcttttatttgcatttttctaatggccaattatgttgaacatttttatgtgttgattgccatttatacattttctttgaggaaatgtctactcaagtccttctcacattctttaattgggttgtttctttttatgttgttgagttagttctttatatatccctgaatattagacacttaccagatatatgatttccaaatattttctctcatcccacaagttgtctttcattttcttaataatgtcctttaatgcacaaaagtcttacattttgatgaaatccgatttacttttttttcacttgttgctcgtgttttgttggcatatctaagaatccattgccaaatccaaggttattaaaatttacccctatgtttttttttaagggttcatggtttttactcttttaaaaaaattcaacttttattttagatacagggggtgcatgtgcaggtttgttacatgggtatattgtacccaggtagtgagcatagtagtaataggtagcattacccctcggctatcttgcctctgcgggttttctctccatgtatgggaaatctgccacatgtcccagccctagccatctttcaagccccttcctttctgtaaagctttctctgatcctgacatattgaaaaaaaaaaaaaaaaaaaaaaaaaaaaaaaaaaaaaaaaagaaggctatacctatacatctttctcattcctctgaggtctctttgcatgtgacattgcatctctccccaccaaaacatagactctatttctctatgctttgaatctcgggcttgaccatgtggcttgttttggccaatggccgatattgttacatgggtatattgtacccaggtagtgagcaataggtagctttagaaaatactgttgagggtaagactcgactgcattcatggggcctgaattctgctgaagtatatttcataagaaatcaggctgtggtgcctaactcatacatatgcaagtggtgataggacgctgctgcgtgggtgtttctcacaaggagcaatgtcgaggggatccaagacaggcgcatgaacgtttctagatgaaactcaggacactgccagtcccagtggctttctctctaaggatgaactcatacccagggaagactggaatcagccttcaacaagtggtgccttgtggttgatgtgtctgcttccaataaggcaagttttacagtctgtcagtgggctgactgcagagttataaatgttgatctcataaaaaagaaacatgagtggttgacacatcacattgtatctgtgtcgttctgtgctctggcagctagaccagctctcacttacagcaacggaggcgacataaaagcagaataatcagattttaattataatggggatttctccatcccatggggctctggagggcaggactattgtgtgacttctggtttccagggaaatatattttcctgtgccactgctgagatgcactttgtaaatgctccccaaagaaatactgcagaatgggatggcttctggcttttaataaccagagtgagaactgataaaatatttgaaagaaatgataactgaagaaatacatagacttcaaaataacacttttaagctctcaagactttaccaaatcaaagcatttgtctgcaaatatgatggcttcagtctccactttatggtatgtctaattgctagaagaggtagagaaagaacagctcatcttaagaacaactcctcccctgaatgcccactacatttgaggctctgcctcactttgcttcctggcaagatatacttccatccatggtctccctgtccctttcaagactttattccagccattgttctacccagggatgcaagggagagaatctcccatctctgatgcggggaactctacataacctgattaaggggacagaaccattcatcacctggtgcaggagacaggactgtccatcatctgaaacagggacagaatcacccttcacatgaaatgcaacacaatcatccaccactagatgcagaggacagaaccacctatcaatcacctgatgcagggggcagaatcaccaatcatctgatgcagggggcagacccatctatcacctgatgcagggacaaggccattcaaaacctgaggagaaagagaattacccttaaatctcagcctggatggggaaatccttaggatctgaggctgctccagggacctatcttctctctgtgtctgcttctctcttttcatctgctccttctctgctctctgccagctgacctcctcaccctcagctcccacatgtccagtttgaacagggttttggatgccctgtttgtcactgaacctcaatgtgcccttcaccttcacctctgctgttcatgcctccatctcccagattcctcttcccagcttatctctctcagctcagcttttcaggacaggccatagtaggtctttggaagcctgtagactggctaccgtaggtcctttgactgttgagtcagtggtggtggcactgcagaaacaggaggaaacaggcacagctgcaggtggagcatgttctcttgggagggctgtgcccctaaagtggaggtcaacctcttagaaggccattggagaccatccaagttcttaaagacaacactccatctcctccatgattgtgttccaacttactttcccaaccttccactagcccagaggaagcatttgctgggccttgcaaacccctcagctatcttgcctctgcgggctttctctccatgtatgggaaatctgtcacatgtcccagctctagccatctttcaagccccttcctttctgtaaagctttctctgatcatgacttactgaaaaaaaaaaagaaagaaaaaaaaagaaggctatacctatacatttttctcattcctctgaggtctctttgcatgtgatatggcatctctccccaccaaaaggtagactctatttttctatgttttgaatcttgggcttgaccatgtggcttgttttggccaatggacattagcaaaggggacacagggaggagcttaaaagagtatgctcagggctttctctctctcttgctggtagaaacctttcatgagaggaaactagactagacttctggagaataagaggccatatacagagaggtcacatctttcccagtcatcctaaacatgtgaatgagaccatgctcagtcatccagctctactgagccaaccctgagcagaactgcccagcccactgcagaactgtgaga

SEQ ID NO: 247 - DNA, 10000 bp, Homo Sapien
agttccaggattgatccatgtattaaatatcagtaaagcttatatgctattttttaggtaaaagaattaaaagacacaagattcagctggccaacttaccttttctgtcttatcttctgctactccccttgaaacactctgttgttcccttgaaattgtatatttgtctttgtttttatagacttctgctttcctgcctatgtgcttttccttatgtttttgcctccatttgaggccactgctcttaaattatttcaaaagagaaagaactattcttattcattcattcacttactaacttatttgtatatgtccccaatcccaaatttcatttttttaattcattcttcattggcaatcattctaatgtatttggtatgtatcattcatttatatgtcattttaaaaagtgtgttttgttttgtgtgtctgtgtttttattctatggaaataatggtaagttgtggatctcattttgtttcatttacttagcactgaagtgccagtcatggtgctctgtgaacatctagttcattctttctaaatgcttcatcaaactccacgtgtatccaccaaacttggtctatccacttttccagttagtgatggacactcggattgtgctgaatccctatcaccataaacaaggctgcaacagacatggctatgtatgtcacttgtggacctgtgggagaatttctttggtctacacacctgtgagtgtaattgctgggttgtaaaatatatgtaagcttgacttgactaggtgccgacagatagatcttgagaatatctgcaccattcttctcctagcaggagggtatgtagggtcctctatccctacactctaccgatagttgagactgcttattttttacattctaactaaattaacagggataagatactgtttcattactgttttcatttgctcctgtgatgactaatgaatttgaatgtctcttgatttacatattagctgttggttttattgcttattcatatttttgcccatttttttcttttgggttatctgtcttgttgacttaatccttacatgtttgcatattgccagttttggatattgttgataaaagattatctctctttatccactcttcctctattaaacaaaaacacttaatttttttaatagaggaaatagtcattttaaagacaggtttgcctttgcatgtaagcttttcaagtttttaaaaagagttatttcttgactctgcattgcaaacatgtactctgacattttcttctattgattttctatttcatctttcatcaatctctctggattttacttttatatgtgattttagttaagaatccaattttattttcttcctaatgccataaataaaacaacctctctttcacctttgatttttgctgttatacttctacatttattgtgatttaaattttcatgtatacatgatctttctctaagttcaatgctttgttctattgttctatttgtccatctgttcttaaatcactacccatttattttattactacatgttgggataggaagtctgccatgggccctggaaatccctgaacattcctgctgagaatgccaaactgcaagacttatctgtctcctgaaactgagcagtttctgtagctggtcgtacaggcagccaagtaggtcaagcaaccatagtatgactatttgtcattctctggtggctgggagggagagggagagggagaggaggagaggaggagagaaggagagactctcctgtttgctgcttactctgaatggtgctgtacccatctgagtggggctgcttgatcattgtcttgcatcacttttatcactcctgtttctaaatgtaaaattgtaataattagtattgatgttttatgtgtatgtgccatgaattctcgtaaaatccatgggtgattgtcccgattgaaaggagctacttgtagagaaattatcatagacagtggatcatcaactagtttcccagttcctctgttgatgtacaacagaaagcaggaagaattcttggaagagaaaagggaatcacagtcattgggtctgtaaaccccatggacccttctgaaccatggatatgtgctactgttaactgtgctcattggactaatatgagtgaatattttgtcaacactcgaatgtgtgtattctgcaattgttgagtggaatattctgtgaatatcaatcatttcaagttgttgatagtgctcttcaagacttgtttatgctttctctaatcttctgcctatcttatctatcagttactgattgaggagtgtttagagctctcattttaattgtgtatttgtctatttctcatttcagctctttgtttgcttcatatattttgaatctgctattagatgcatatacatttaaatttttaaaataaattaacaattttatccttaggaaatattcctctttatctctggtaacaagacttgttctgaagtctgcatcatctgatattatcttaggcattgcagcttcctttcatttagtgcgtgcatggcatgcctctttctatcctttcacttttaacttaaccatgtgtttatatttaaagtgggtttcttgcagatcatatttagttattattttaagtccaatttgagaatctctggctttaaatgggagtgtttacaccaagggtcaacaaatgttttctgtaaagggccagacagaacaaatgttaggcttttgggatcatatggtctctgttgaaatcacacaactctgctattatagcatgaaagcagcacagataacacaagaatgaatgggcgtggctgtgtttcaatacaatggaacgttataaaaaatgatgatgggctgtatttggcccatgggacatagcttgctgactcatggtttagacccttcacatgtaaagtaaatattgtcatagtcaagtttaaatcactcactttgttgtttgttttcagtttgactcatgtgttattcatttcctaccatcccctgccaccttccatatcctttggattgtgtatttttaggattccattttatctccatttttcaatgtattatctgtacctctttgtgttattattaaatgattgctctgtggtttactatatacataccacagtctaccttaatattacagcactttatagatagtaaaagaatcttaaatactttcacccccccagcattttatgtgattttttgtcatacatttactttatttaaattataagacctccaatgcattgccactacttttgtttgatgcaatcagttatcttttttaagacagtgatcccaggcctgctgtgttaacttgctttttttgcacaagtgcaataaaggatgtattctttttcaactagagtctcacaagataagttctgccaaaaatgatttatgtgacccttttctcaattttccctcaggcaggatacaaccaatgcctttctaaatgtataggagccaagttaactcattacatataacaaatgtattatgtaatgtactttacatattataaaatgtaatactatacaaaatacaatagtttactatatataataaatgcattagggtttgtcttccagaatctgggttgaattggtggggtacattgaaaactggaatgcactatacaagcttagcatgacctgatataataagagcaacgttatctatcatttatctattagaccaagagcgtctctgccactcttccatattccatggtaggtgaagtaatggctctccaaagatgtccatgcctctggaacctgtgaatatatgaccatacactgcaaaagaaactttggagatgtgattcaggttaaggaccttatgctggaaaaactatcctgaattatccaggtgggcccaatgtaatcacatgaatccttaaaaatggaggatctcttctgactgtaggcaaagagaggtgtgactgaaaaagtgtgtctgaggcatcaaagcttctggctttgaagatggaggagagggtcacaagtcaaggaatgtgagctgtctttagaagctggagaagtgaggaaacactttctctcagggcatctcagtgagacctgtgttagacttgtaatttacaaaatgctgagagataatacatttttattgttaaaattacatttgggctaatttgttgcagcagcaatagcaatacaccttcttttttcagaaatgatgaccctatcagggaggatgatttatccattaggcattgttgatagtgctttggtagtagggattcatgagaagctactgggggagtattcactgtgtgtgtcaaaaaatggttattggggataataatgaatgagactgagattgtgagcatgtagggaagtccctaaatacctgcagtattatcagtgaacatttctttaaaaatacttaacatgtttatctatatttatactttcaaatgaagaaaactcaaaggcatttgtccaatactttttgtaagtaacttaacctttctggatatgtttacttgcctataaagtagaaatactatgcctctccataacctatctcaaaattcttggcatcaactcagttaaggtatgtataagatctttgaaagaacagatcctatccaggtggctccatgtttactcagtgtgtgccatgcttcagaaatagtggtgccgtgtatgagcatgtcaggtttaatcatccacccgattgctgtcccaaggctgagtgttgtgatcgcaatgctgctattggcacttgttcttatgaaatctctgtgtctcccacgtgaaaaattgttttgttaaatacgcaattctggattgatctgtctgtccgtctatctatctatctatctatctatctatctatctatctatctatctatctatgtatcttcagtgctcagatggtatttaattatctgatggcttccataggataaagttagctctaaggctaagttcctcctttgcagatcatcagtactttctctggctgattttaagatctttctgactttgtgttctggtgacaacattgtgtgcacacatagatttctttttatttgccctgcgtggaatatatagtgtttttaaaacctctataatcaagacttttatttgttcatggaagattaggaagattcttattaggaagattctagccattatttcttgccactccttctggaactccagttagctgtgtgttgcattgtttattctatccctccatttctcttaacttccttttggtattttcttttttttcctgtgtaatttactcatatataaattctgggtaatttattcagatatacctcccaatacaccaaattattcattatgcagtgggcttttcccatttgagttcaatacttttaatgttatttcagatctgcctggttatttctagcagtcctttcacttgctcatctttgtgatttcctcttttattcctttaaatattatctactcagccactctattttctgtatctaacaattctaatttgaatatctgcagtctaaatgatctgttgtttctgtttactcacacatagtggattgcctctaatgtatttggtcatatttaaatatgaactcttattttcataagttaatttgaggaaatcctgaaggcctacattttcgatttgcttctttctagaaagattttcatctggttcttccaggagtcaagaggacgactgatctgcagctacttttgtatcttcaaaagtctccgattcacgtgggagccccagttttagttcatctgcttggcggctgtctcaacctcagtcttaaggtcacagagctgctactggcctttgtcctcaaggagaccctgtggcccatttgctcactactcactgctcttagtttccagcttctatttaagtatataagttagaggtgttttttttttttttttttttttttttttttttttttttatcacgggtgtgtgcccatggggagagtgtttccttagagattttccctaatttttgagagtctattaatacataaatcttgttacccaggatttagttattctccaggagtagtcctcctccctgccagactgtctagtctttgtaatgccagaagcaaaatccctaatttgcttattttttaaaaaattattattttaaaattgggcctaagaagcagaaggttgagttcgtcacacttcgcagttcaggacatatcacttgcccatgcacggctgatcttttatttattttttgatttgattttattccatttctctacttccatcaaccccacaaccattttaacatatttaatatgtatccctttgttttatatgtttttataaaaatagttttgtatgcacatattcagttaatgcatacaaatggtattgtgttatctcattttgtttcttactttttaaaagcacaatgatttatttatttctgtttttggaggagtctcactatgtcacctaggctggagtgcagtggcttttcacagggataatcccactactgatcagcataagagttttgacctactctgtttccaacctgggccagttcacctcttcttaggcaacctggtgggccgctgctcccaggaagtcaccatatcgatgctgaacttagtgtgaaaacctgataggcagagctgacttcagcccagaagtcctgggctcaagtgatccttctgtctcagcttcctgagtagctggaactgggattataggcatgcaccaccgggcttggctaaagcacatgtgtttaagatccacccgggagggcgaggtggctcatgcctgtaatcccagcactttgtggggccaaggcggtggatcacctgaggtcaggagtttgaaaccaacctggccaacatggcgaaatcctgtctctactaaaattacaaaaattggccagttgtggttgtcagcgcctgtaatcccagctactcaggaggctgaggcaggagaattacttgaacccgggaagtggaggttgcagtgagccaagattgcaccactgcactccagcctgggctacagagcaagactccatctaaaaaaaaaaatccactcagatttctctatgtatgtctagtttgctgtttctagcatcttcatagaactgcgtggtataaatccatcacatctgtttatccatacttccagtaataagcatattgcctctgaatccccataaatctcattattttagcaatgtgaaatcagaagatctgggaggcaaattgttttgttcaagatacataacagatttttttttcagtttttgagcataaattgcttgattattgatccagtaataaccctactatatcctattgcttcctcatgcatccttgattgcaactattatctgaaataaagcagaaaggtcttgtatcattttgagcaaataacatacctactatatgatcaaagacttggagtctagaacagggatccaaataggcttcatcttgattaccatgttggatcgaatggtagaggcttctgcaagcactgtcaggaagaactgcggggcacatttgagatctgcagcagactgtgctgttatcatcagtagatgcctgtccaaagcttgggatgaggagtattggtcatctatcttatccttgatctttcagctgagttagagaatggataaatagcgttgaaatatctttaataaacacctctggaaattacaaatgcaaagcccaaatatagttgatgaggacgtttaatttctctgtgcctttagtactaagcacctatcccatgacttaggaaacgaaggaactgctatgattttggattacttaaagctggctatttaaaccaattccttacaccctcaaagggtaatatttaatttggagaaggcacatttgtttagaaataaatgtgagatattaattatgttaaaatataatagctgtctatatgaattgttttagaaataaaaacatgttcaaaaggtcatggtagggctcttatgaagaaatgaggggatgtttgggactttaataactgattaaaggactagaagctatgtagtgatggtttggggaggtaatccctagcaggcagtgtgaacagaatcacgtaggaatcactcaaagatgaagcagacgtggtagattaagacaccagagtgtctttgtctcaggtctgaataaatctagactccaagtttgggaaggagggactctgggaggtcatctagtccagattctatccatatttaaaatatgttacccatttttgtttgaacacgtccattgacggagacctcactactgaaaagatagctcaatttctttttttaaaaattatttgttttatttaattttaattttttattattttatttatttatttatttatttgagacaaggtctcactctgtcaacctggctggagtgcagtgacacaatcatggttcactccagccttgacttcccggctcaagtaactccctgctcatcctcctgaatagctgggactacagacacacaccaccatgcccagctaattttttgtttttatttttagtagagacaagttcttgctatcttgcccaggctggtcttaaactcctggcctcaagcagtcctcctgcctcagcctcccaatgtgctgggattacaggcatgagccactctgcctggctccattttgtttttggaaaggattgattggaagtttttccttgaataattctaaaatctgcctcttgtaaactcattcaccaggcccagttatgttatctggaaaagaatccagaaggagttctgtaactttggaataataatgcccctctcatagcttccacaattccattggtaggagggtaaagagagggctgtggatccccatatatccctacatctcaccatttacaacctcaggtgcttctagacattgccaaatgtccctggggtaggtggatggagagcaaatcattgccattgagaacaactgccctagactctgttcctcaacctccttttctccacatatttttgtcttttatgataaaatattttggaaactatcatctttacttttcgtcctaattttttatctacaaatctctcttaatccccttttaggtaaggagtctgaccctattgctcctctgaagcttctcttgttaaggtcactatagacctcgatgttgctaaatccaatgttcaattttcagtcatcatcttacctgacttatcagaagtatttgacattattgatcactttctcttcattaaagaaatgtctttaccttgaatgttacctcgttcttcatttttctcctatcttattggtcaccatttgtctgcctttatcatctgactcctaaaacttagtaagcccggggctctgtgcttgcacttctcttttctatctgcattattcccttattgactgtgtccagtctaaatattaataatatctaatacattattgattttatagttagatatccaacctgacttaccatttaaacttcatactcttatccagctgctactcagcacttcaacttgcaaatctattagttcaaacttaatatgttccaaaacaaacttccaattatcctgctctttaaatcctctccttctgtagtctttaaccggtaaaaggaagttttttttgttttttttttttttaatgtatcaaggtttacatcacagagtctcctttattttttttcacattcttttcctattttttgaaaagtgttttgcatttaccttagagacatattggaagtctggaccatttttatgcacctccagcattaccagctggatccaagctactatcattcctctcaccatccccagatcattgcaccagtctctcaaagagcatccctgcttccttcctctctctgctacctccctctgttgtctatagtcaacacagccactatcgatctgcataaaaccatgttaaaatgaggaaatgttggtcaaag

SEQ ID NO: 248 - DNA, 10000 bp, Homo Sapien
agttttagtatagtgaggcactcatcatttctggaaatggtgggaacccccaccccaaaatcacaagttcctagttaccagccaggggccaaccttgcaagcaggtctttctaaggatggcagtcttaggcctgctactttaaccctttttctacatatgtgccagttgatatcagaacaacgaatccatgttgtaaatctgggggcaactactaaaagaacaattttctttttttgggtgtggggaggggttggtttgtttttgttttttgttttgagacggagtcactcagtcgcccaggctggagtacaatggcgcgatctcagctcactgcaacctccacctcccagattcaagcgattctgcctcagcctcccaagtagctgagactacagtcacgcgccaacacgtccatctaatttttgtgtttttagtagagacggggtttcaccatgttggccaggatggtctcgatctcttgaccttgtgatccgcccgccttggcctcccaagtgctaggattacaggcatgagccactgcgcccggcccctaaaagaacaattttcaaaagcatgcagaaagtgaagttggacctttaccttacaccatatccaaaaatcaactaaaatgaatcaacaacttaaacataagagttaaaattataaaactcttagaagaaaacggtggaaaacttttgcagtattggatttagcactgatttggatatgacaacaaaagcatggacaacaaaagaagatacatatattagacttcatcaaaatcaagaacttgaacatcaaaggacactatcaaaagagtgaaaaggcagcccatagaatgagaaaatatttataaatcatatatctgataaggggttaatacccagaataggctggggagggggtggctcacgccagtaatcccaacactttgggaggaaggcaaatcgcttgatgccaggaatccaaaaccagcctgggcaacatggtgaaaccccatctccacaaaaaatacgaaaattagccgagcatgatagcacatacctatagtcctagctactcaggaggctgaagtgaaggatcccttgagcctgggaggcagaagtttcagtgagctgagattacaccgctgcactccagtctgggtgatagagcaagactctatctcaaaaaaaaaaaaaaaaaaaaagggcacacggcacatagaccaatggaacagaatagaaacctcagaaaataatgcacacttgtaacaatctgatcttcaacgaagtcaacaaaaacaagcaatggagaaaggactccctattcaataaatggtgctgggataactggttagccatatgcagaagactgaaactagaccccttccttataccatatacaaaagtcaactcaacatggattaaagacttaagtgtacagcctaaaacttataaaaacccttgaagaaaacctaagaattaccattctggacagtaggacaattacattctggccaagatttcatgatgaagatgccaaaagcaattacaacaaaaaaattgacaaatgggacctaattaaactaaagagcttgtgcacagcaaaagaaactatcaacagagtaaacagataacccacagaatatgagaaaatatttgcaaactatgtatctgacaaaggtctaatatgcagaatctgtaaggaacttaaattaacaagaaaaaaataaccccattaaaaaatgggtgaaggacatgaacagacatttgtctcaaaagaatacattcacgtggccaacaagcatatgaaaaaatgctcagtatcactaatcattggagaaatgcaagtcaaaaccacaagataccatcttataccacccagaatggctattactaaataaagtcaaaaaataacagatgctaacaaggttgtagagaaaagggaatgcctatgcactgttggtgggaatgtaaattagttcagtcattgtggaaagcagtttggtgatttctcaaagaacttaaaacagaactaccattcgggccagcaatcccattgttgagtatatgcccaaaggaatgtaaatcattgtaccataaagacacatgcatgtgcatatttatcacagcactattcacaatagcagagacatgaaatcaacctaaatgcccatccgtggtagactggataaagataagtgtatatatacaccatggagtactatgcagccataaaaaagaatgagatgatgtgctttgcagcagtatggatggagctagaggccgttatcctaagcaaactaatgcaggaacagaaaaccaaataccacgtgatcttacttataaatggcagctaaactttgagtacacatggacaaagaagggaacagcagacactgcagcctacttaatgttagacggtaggaggagggtgaggatcaaaacactacctatctggtaccacgcttattacctggatgatgaaataatctatacactaaaccctgcaacatgtaatttatctatatcgatataacgaacctgcacatatgcccctgaaactaaaacagaagtttaaaataaaatatctgatttttctttattaaaatgaaataaaatgagaggcatgtgaaagaaatattagagttaaaatgattgctagatacaaagacaagacacaaaaattaattgcaattctcactatccatgatgtaagaaaaatgaaatttgttaaaagatattctagtaccattagaaacaatcaagtgtctaggaatgtacttaacaaaagatactcaacaatcattgttgatttctcctttcttttgattctagaacttccttggaaagtgtgtttcctccttcagagaatgttctacagcacttaggaaaaagtagtaataacaagatgatgtaattaaataggctctataaatgggctaagctgttaaaatattctactttatatccctcctttaaaatctagcaacagttgtctatacaatattaagatcttctctatatatttaaagttaaaatataatttttaataagtttttaaatttttttatttcaattttgttacttagaacattaagatgcatatttgtgatctaaagaaattgtcttgtccattttaaaaacctttattaagtcacttttaaaatgtattgaccaagaaggaggtttgttgttacatcaatgtttgtgaaatgatttccatacataaaaaatgtaatttacctgaactttgtcttaagactcttacattggattataggataacagataaataaactgtatagatacattcagtatcatacaacattttggaatgtgtatgctttcaggcttccaagataattaaattactgtcatgatacatttcatgcattttttatgacttcagtataaaacattcaggtgtgttagccttccctgggaagggtaaacttgtatgtgctttggtaaagtacttaaattccaatgttccctatagtgcttgcattcattttgtgaaaagttttgttgtattgttagaacaattttcaaaggctgattttatgccttatctgatagaaatatagaatagatagttctttaattgcttactttttaaaagtaatataatatttaagttgcatttttattaatagtaagattaacatttaagtctgcattttctttaaatgttttaaatgtttatagcattcaatgtgtagttggatttacttgactaaaaattagccctttaacgtttatatttgttgtatttatatttaataaaggcatctaatctttagtaccactgtgaatttaatgctttcttcaggttcagtggcattttcttttttgtttttccagaataacaaatattctttatttattttatttattttaattgccagatagtagttgtacatattcatggggcacgtagtaatgttttcatatacataatgcattttaatcaaatcagagtagttagcatatttatcatctcaaacatttatcatttgtttgtcttgggaacattcaatatcccacttgtagctatgtgaaattatatattattgttaactatagccatcctatagtggtacagaaagctagaactcattcctcctatgtagctgtgattttgtatccttaaacaaatctctccctatcttccccttcccagtctttagtatcctttgttctaccttttatttctatgatatcaacttttctttagcttccacatgagtaagaacatacagtgtttaactttctgttcctggcttatttcacttaacataatgtctgctagttccatccattgccacaaatgacaggattcattcttttttatggccgaatagtattccactgtgtatatatatcacattttatttatccattcatctttgttggacacttagtttaacttcatatcttgtctgttgtgaatagtgccataccactctttttttttatactttaagttctagggtacgtgtgcacaacatgcaggtttcttacatatgtatacatgtgccatgttggtgtgctgcacctgttaactcatcatttacattaggtatatctcttaatgctatccttctcccctccccctaccccacgactggccccggtgtgtgatgttccccaccctgtgtccaagtgttctcattgttcagttcccacctatgagtgagaacatgcagtgtttggttttctgtccttgcaatagtttgctcagaattatggtttccagcttcatccgtgtccctacaaaggacacgaactcatccttttttatggctgcatagtattccatggtgtatatgtgccacattttcctaatccagtctatcattgatggacatttgggttggttccaagcctttgctattgtgaatagtgccacaataaacatacatgtgcatatgtctttatagcagcatgatttataatcctttgggtatatgcccagtaatgggatggctgggtcaaatggtatttctagttctagatccttgaggaatcgtcacattgtcttccacaatggttgaactagtttacagtcccaccaacagtgtaaaagcgttcctatttctccacatcctctctagcacctgttgtttcctgacttgttaatgattgccattctaactggtgtgagaaggtatctcattgtggttttgatttgcatttctctgatggccagtgatgatgagcattttttcatgtgcctgttggctgcataaatgtcttcttttgagaagtgtctgttcatatccttcgcccactttgtgatgggggttgttcgattttttcttgtaaatttgtttaagttctttgtagattctggatattagccctttgtcagatgggtagattgtaaaaattttctcccactctgtaggttgcctgttcattctgatggtagtttcttttgctgtgcagaagctctttagttacgttagatcccatttgtcaaatttggcttttgttgccattgtttttggtgttttagtcatgaagtccttgcccgtgcctatgtcctgaatggtattgcctaggttttcttctagggtttttatggttttaggtctaacatttaagtgtttaatccatcttgaattaatttttgtataaggtgtaaggaagggatccagtttcagctttctacatatgactagccagttttcccagcaccatttattaaatagggaatcctttccccatttcttctttttgtcaggtttgtcaaagattagatggttgtagatgtgtggtagtgtttccgagggctctattctgttccattggtctacatctctgttttggtaccagtaccatgctgttttggttactgtggccttgtagtatagtttgaagtcaggtagtgtgatgcctctagctttgttcttttggcttaggattgtcttggcaatgcgggctcttttttggttccatatgaactttaaagtagttttttccaattctgtgaagaaagtcattggtagcttgatgggcatggcattgaatctataaattatcttgggcagcatggccattttcacaatatttattcttcctatccatgagcatggaatgttcttccatttgtttgtgtcctcttttatttcgttgagcatggtttgtagttcttgaagaggtccctcacatcccttgtaagttggattcctaggtattttattctctttgaagcaattgtgagtgggagttcactcatgatttggctctctgtctgttattggtgtataggaatgcttgtgatttttgcacgttgattttgtatcctgagactttgctgaagttgtttatcagcttaaggagattttgggctgagacgatggggttttctaaatatacaatcatgtcatctgcaaacagggacaatttgacttcctcttttcctaattgaataccctttatttctgtcttttgcatgattgccctggccagaacttccaacactatgttgaataggagtggtgagagagggcatccctgtcttgtgccagttttcaaagggaatgcttccagtttttgcccatgcagtatgatattggctgtgggtttgtcataaatagctcttattattttgagatacatcccatcaatacctagtttattgagagtttttagtatgaagggctgttgaattttgtcaaaggccttttctgcatctatcgagataatcatgtggtttttgtctttggttctgtttatatgatggattacgtttattgatttgcatatgttgaaccagccttgcatcccagggatgaagccaagttgattgtggtggataagctttttgatgtgctactggattcggtttgccagtattttgttgaggatttttgcatcaatgtttatcagggatattggtctaaaattctctttttttgttttgtctctgccaggctttggtatcaggatgatattggcccctaaaatgaattagggaggattccctctttttctattgattggaatagtttcagaaggaatagtaccagctcctctttgtacctctggtagaattcggcttgtgaatccgtctggtcctggactttttttggttgtcaggctattaattattgcctcaatttcagaacctgttattggtctattcagggattcaacttcctggcttagtcttgggagggtgtatgtgtccaggaatttatccatttcttctagattttctagtttatttctgtagaggtgtttatagtattctctgatggtagtttgtatttctgtgggatcagtggtgatatcccctttatcattttttattgcatctatttgattcttctctcttttcttctttattagtcttgctggtggtctatcaattttgttgatcttttcaaaaaaccagctcctggattcattgattttttgaagggtttttttgtgtctctatctccttcagttctgctctgatcttagttatttcttgccttctgctagcttttgaatgtgtttgctcttgcttctctagttcttttaattatgatgttaggtatcaattttagatctttcctgctttctcttatgggcatttagtgctataaatttccctctacacactgctttaaatatgtcccagagattctggtatgttgtgtctttgttctcattggtttcaaagaacatctttatttctgccttcatttcgttatgtacccagtagttattcaggagcaggttgttcagtttccatgtagttgagcagttttgagtgagtttcttaatcctggttctagtttgattgcactgtggtctgagagacagtttgttataatttctgttcttttacatttgctgaggagtgctttacttccaagtatgtggtcaattttggaataagtgtgatgtagtgctgagaagaatgtatattctgttgatttggggtggagagttctgtagatgtctattaggtctgcttggtgcagagctgagtttaattcctggatatccttgttaactttctgtctcgttgatctgtctaatgttgacagtggggtgttaaagtctcccattattattgtgtgggagtctaagtctctttgtaggtctctaaggacttgctttatgaatctggatgctcctgtattgggtgcatatatatttaggatagttagctcttcttgttgaattgatccctttaccattatgtaatggccttcttggtctcttttgatctttgttggtttaaagtctgttttatcagagactaggatcgcaacccttgcttttttttgttttccatttgcttggtagatcttcctccatccctttattttgagcctatgtgtgtctctgcacgtgagttgggtctcctgaatacagcacactgctgggtcttgactctttatccaatttgccagtctgtgtcttttaattggagcatttagcccatttacatttaaggttaatattgttatgtgtgaatttggtcctgtcattatgatgttagctggttattttgctcattagttgatgcagtttcttcctagcattgatggtctttacaatttggcatgtttttgccatggctggtaccggttgttcctttccatgtttagttcttccttcaggagctcctgtaaggcaggcctggtggcgacagaatctctcagcatttgtttgtctgtaaaggattttatttctccttcacatatgaagcttagtttggctggatatgaaattctgggttgaaaattcttttctttaagaatgttgaatgttggccccgactctcttctggcttgtagagtttctgccaagagatctgctgttaatctcatgggcttccctttgtgggtaacctgacctttctttctggctgcccttaacattttttccttcatttcaactttggtgagtctgacaattatgtgtcttggagttgctcttcttgaggagtatttttgtggcgttctttgtatttcctgaatttgagtgttgacctgcctcgctaggttggggaagttctcctggataatatcctgaagagtgttttccaacttggttccattctccccatcactttcaggtacaccaatcagatgtagatttggtcttttcacatagtcccatatttcttggaggctttgttcatttctttttactcttttttctctaaacttctcttctcacttcatttcatttatttgatcttcaatcactgataccctttcttccacttgatcaaatcggctactgaagcttgtgcatgcatccgtagttctcgtgccttactgtcagatcatttaaggacttctctacactgtttattctagttagccattcatctaatcttttttcaaggtttttagcttctttgtgatgagttcgaacatcctcccttagctcagagaagtttgtttttactgatcgtctgaagccatcttctctcaactcatcaaagtcattctctgtccagctctgttccattgctggcgaggagctgcattcctttggaggacaagaggcgctctgatttttagaattttcagcttttctgctctggtttctccccatctttgtagttttatctacctttggtctttgatgatggtgacgtacagatggggttttggtgtggatgtcctttctgtttgttagttttccttgtaacagtcagggccctcagctgcaggtctgttggagtttgctggaggtcccctccaggccctgtttgcctgggtattaccagcagatgctgcagcaaacattgcagaatggcagatgttgctgcctgatcctgtgtctggaagcttcgtctcagaggggcacccggctgtatgaggtgtcagtcagcccctaccaggaggtgtctcccagttagactactcgggggtcagggacccacttgaagaggcagtctgtccattctcagatctcaaactccatgctgggagaaccactactctcttcaaagctgtcagacagggatgtttaagtctgcagaagtttctgctgc

SEQ ID NO: 249 - DNA, 10000 bp, Homo Sapien
ccaccgtccctggctaattttatttttttatttttttgggacagaatcttgctctgtcacccaggctagagtgcagaggcactatcttggctcactgcaaccttgcctcctgggctcaagcagtcctcccacctcagcctcccgagtagctgggactgtaggcatccatcaccacatccagctaatttttgtgtttttgtagagatgggattttgccatgtttcccaggctggtctcgaattcctggacttgagtgatctgcctgcctcagcctcccaaagtgctgggattataggcatgagccactgcacctggcctgggttaatttttacactttttaatttttagagatggggtctcactatgttgccaggctgatctccacctcctgagctcaagtgatccttctgccttggcctcccaaagtgctaggattacaggcgtgagccactgcgccccagcttaaattctttgcgtgcctcccagtgcatataaagtaaaatcaaacgtctcattgtgtcctgtgagatcccgcatggcctcttacctgtaacctctatttgtgcgctttctcttctcctactaaatgtgtgaatgcgtgtgtgtttttttatgtctgtcttccccacttgaatataagttttttgaagccagagacgtgtcttttttgttcattttgtagctttaccatgtaatacagcatctggcaaatagtagatgctcagtatttgctgaataaacatttgataactcaaccttcatcttcttgcaggttttacttggggttctggtggcttcatctcataaaggttgtctgcaacttcgggaccaaagtggttccctgccctgcctgctcctggccaagcactctcaacccctcagtgacccacggctgataggtttggagttcagatgtggaaagaagatggtagtgggatggtggttctcatagccaggggagcctgggaggaaaagcctgctgggatttactagagatgcagaagtgacacatgtcaatcaacaacttctgggagacttgtatggcaggcagagaacaggagcaagaggacccctagccagaatttccagcatgcatttctccaccgtagctcctaacatgcactccaggattacaactgtgtctcctacattcttagtttggagagaaggtgtcacccctctaaggtgggggtcaggtgtgggctttcatgtcatgtgagggcagcagctctggcctgggatgggtagtgaggccggtaggatggtttgccttgcaacccaccccacaggtctcctttcttgtcaaaacagaaaactttcttcctctaggctgcctggtgcgggcagagaggtttcagttgatcgtagagagggacgtgagaagcagcttcccttcctggaaggagctgagcatgccaggcttcatccagaagcagcaggccaggttggctccttggggtcatggttgtcttgagtctggggggaaggaagggcctggtggaaggagtgggatgctggggaccaaaatacccaatgcctgcatcactaagaaatgtattccttgtctctcccaacagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggtaaactgggactccagggacccaggacctgacctgcgccctgagcctctggctaggatcccagcactttgctctccatcctcccaggttcacctcattttctttggctcttcagtccgctggtttgagttcttgcacccgggacaggtgtaccgactcgtagctcctggccccgctgtgagtgtcctacttcatcatacctttccccagaaagcttttttggggttggggtctaaagagggcatgccagtgcctggtcattctctaggcctcctggaagaaggctggatttagatacaccagaaagcctgtgtgtgttgacacacttccttctccatgctccagaaagaacaaaattgggtcagaatgttttgtgaacctcccactggactagcacacactcacaggcagtcgtcttcccatttccgtgcagacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaagtaaatgtccaccaagcccctctggttaatttggccactctctcttctcccaagctagctgggtttggtgaagacttcattttctgctgcaggaggtatttcttttgttattgttgtttttgtttgtttttttttgagacggagtctcactctgttgcctaagccagagtgcaatggcctgatctcagctcactgaaacctctacttccctggttcgaaggattatcctgcatcagcctcccaaatagctgggattataggggtgcacgccaccacacccagctagtttttttgtatttttagtagagacagggtttcgtcatgttggccaggctggtcttgagttcttgaccttaagtgagcctcccacctcagcctcccaaagtgctgggatttaggggcgtgagccaccttgtgcgggttttgaatgatctgccacaaccctctttttcccataggccctgttactcttagtgtgcagtgtggcagagctcaggttttttcaggactttatatatgaagttctagcagatactttagctccattttctgccttgaatctgactgtctccactctgtgctttcttgtgcctccattctcagtgtatttccctgaccttccagtttcacagattccttggtgtctttctccgctgagattttgtcacggacactatgtgaaccccttgtggcgtctctctggatgaaactgggtaatgacccttcctttgtggggaaggtatgaaatagagtgatgggactttgtggacttcacagatcctactaacacccaccttccttctatagggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccaggtgaagatgtgtagtgtcacctgcctcctcttgctactgatgtggctctctggaatgtgcacccctgcttaactttgctgcagcgaccccttctctttcatacaggtttccatatatcagtctgccatttgtgcccagccagtaccctcacgaggtgttgcaggctggtcctcctcctagtcttcccctagctttggtagagccatggctaggatatgtccctcagggggagtggccactctgtggtgcttgatctctgagtcccagcttctaccccaatttgccttgtcttcctggtcactcactattcctcttccacttgcagatctcacaatgtttattgttgtttccggtcatccacttatgtgcaggtcctgagttttccccctgagaccaccatcaggtcagtgcccagaccccaacccctaaacttcctggcttcacatctgcatctcccacatgtccctggttctgaagattttgccatcattacagtcttctccaatcccaacaagatgtgttgagtcagaggagcttctctactccaaataaaaaatgctctgtgtctatcattgtacccagaatcatttagtgttctaggcttttgaaggcttttcagtcttaacatgcaaatatttcttggctaacatcatggtgttcaaacctgaaaaataaccaatgactatcagagatcaggaattaaaatggggcttctaggagcgcatggaacccactgctgtccccatcctgatgccctctaagtccttctagacccaccctgctttcagaacccctttgcctgttctgttatcttgacccctgtctctgtctccctgtatttatttagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcaggtaagggagggaaggaacaggctgaactgagtatggagtgccagagggatgtgatgggaccaagaggacttttccaaccactgtcttcatcccagggaaagtgcactcgcctgggctccacttgccctacgcagacagctataagccaggccatcatcaggtgagagcacaaggcgtgcacccattgtgccatttacttatgagaccactttgtctatctgcagtttctacattagcataattcctggctcatgagaattgcttaatattttttgaacgaatgaatgagggtaagctcctaaatctgtgagccaaagactgcagacagcggggagggaggcatgttgggtccagggtgttggcaacctgggttgctataggcgtttttatttcctcctgctccccataggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgaggtgtaatgtggctgggagggagggactcggatacccaaattcctgggcttttggcaaagggtttaggagccagttaaccttgaccttctctttctagtcttcagccagggttgacgagcccatgaccatgttcctctggacactttgtactagcccctctgtcctccgtcctattgtgctttcttttgagctggaaaggaaaccgtcgaagatcgtcccattaggtaaggttggagacggggggatcatgatgatagggggatcatggtgatagagatagatgggtccctgggaggaagagggatgagggactgatggggaatttctggagttagggaggagaatggtgggtgggaactaaaagccacatgcctgagacgtgtgtttttcctctcttcccacctcagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttctcactggtactcatctctggggtcccaggcctcctgactcctagttgtccacctcctaggaactcctagtcgttcatcatcatttcagccctttgccgccagggccaaaggtggaaagtgatttggaagagaagagcttttcgtccagcagaagaaatggtaccaaaatcagtctgtaaaggaagtaaattggggagttggcggcaaggcagagagcatagctatgatggtctcagtcagtaaggctgggccctgcaggaagtcaaatatgaatgcctagaggtgttcacaagcacaaagaaggtgtagggggaggcaagtgccaggcacaagcaggggcaggtgaggactctgggtgactgtgctatagggccccaggctacggttagccctgtaggtttcccaagggcctggcctaaggcagatccttgatcgatataccttgagaccagaaggtgctccgaaatcacaaccgtacaattaggggatctaggaacaattctttggagataccaatgcctttggctggtgttgctgcatttctttactggggactgatagatggagaggtggaaagatgagctgaggcacatctttcagagctactgggaggccatttcttcctggctgttaggatttgttcgtgtttgggagacctttagagcgtggttaaacccatatgttgggatttatgctgcttttatggtagcaataccctatattaagatttgaagtagacccggaaagttagtggccggttagctcagttggttagagcgtggtgctaataacgccaaggtcgcgggttcgaaccccgtacgggccagtgggtggcttttttttgtgtgtgttttgttttctgaccctctgctgttatccggaagtttctacccggagccagttgccttctggtaacagaattatattgcacctactgcttcctattccctgaatcactagcgctcccgaaggcttggagggaggagtctctgggcacccgggtgaaaggaaggttcacgtgcaaccgccgcgtctttttttccctgaagcgctttcatggaggcagatgtttgtcagtcaagggaagtaagaaaggcattggatgaaaacgaagccctaagcctcgtagtcgtggccgagtggttaaggcgatggactagaaatccattggggtctccccgcgcaggttcgaatcctgccgactacgtcatatttttttcttcagcatactgaccatatttctctccaggatgggatgatccagtcggcaccctccaaacctctcatctaggaactctagaatcgagaatttgatttagagtctatgattttggtttgaaatctatgattaacgtctttggacattgaaggaaatccgaggaatggacaagtgatgcaagagccagttgagttaccaaattagttctagaaagatctgaaaaagctcggtccgggttcctagctctatattcttgtagatgaatttcaggaacctttatggcagcttcggcgccgtggcttagttggttaaagcgcctgtctagtaaacaggagatcctgggttcgaatcccagcggtgcctttattcaattgaaacagcgtgattttgcggctaaatccacatcctttcatgtattgtttttatatcagaacgcgtaagagtttctgttctgcactcatagcacccacatttcctgcagagtcaagctgccactcccatgagatcgccactctaaaaggtggttctctaacttaggggcagaaatgttgcataggcctaagggtcctttgcttaactgatgccacaccccactggtgcaggtggactgggtcaggcggccgccccaccctcgatggaaggggctgcccaccttccaggcctctttctccaccctaggacgtcccctagaacctgagccactttgttttgtttggctcttcattatagttctttgggtttggtggctcataatgttatatatatagtatataatataaaaatatatatttaaatatacagtatttaaaatttggcacagcttccagatgcggtcctctaactggtctttcacttgcagttacctccatccctctccaccagcgggatgtcagggtaaggagtaagcagggatccggctggcctggcctggcctggcaccaggtttcgtgcagcagggtgcagaagggctgaggccatgtgaacagagtccaagaaagcatcattcgggagtcgctagggatcctggtgtggaagggcagggcacttttctggagcactgaagctaggctggttaaggaagaaataaatgccagagataaggcaagaaataggatctgtgagctcttggcaggacctaaacctccttggaagataggcagaaagctctcgacaccattccatggcccacgaaccaatgtaagatgagcaaatggcttgaaggaattgctacctccaggtcaagccagggatgcagcactgccgagaccacgtttgtgccaagcactgggctggaccctgtgcagaaccaaatgaacaaggcacgttcccctttcagcactaacggcactgtaagaacagggagaagtggaatctaatctggcctgagggtagagggtgatcagctaagtctgaaacaccatgtagaaacttgccatgtatggccgggcgcggtggctcacgcctgtaatcccagcgctttgggaggccaaggtgggcggatcacgaggtcaggagttccagaccagcagcctggccaacatagtgaaacctggtaacatagtgaaacctcgtctctactaaaaatgcaaaaaattagccaggcgtggtggcaggcgcctgcagtcctagctacttgggaggctgaggcaagagaatcgcttcaaccttggaggggggaggaggtgttgtcagccgagatcgcgccactgcatcccagcctgggcaacaagagtgaaactccgtctcaaaaaaatgaaataaaataaacgaatgatcagctgtttgttagttcttggttattaaaagtggggtctatgtacgcacttttctgaggaaaaaataaagtgtggggtatgtggatgggattatgtgtgaactccctggattgtatacatgtttaggaagagggccatagctttttttttttttttttttttttgagacggagggagtctcattctgtcacccaggctggagtgcaatggcacaatattgactcactgcaacctccgcttcccgggttcaagcaattctcctgcctcagtctcccgagtagctgggattacaggcgcccgccaccacgcctggctaatttttgtatatttagtagagacggggtttcaccattttggtcaggctggtcttgaactcctgaccttgtgatccacccacctcagcctcccaaagtgctgggattacaggtgtgagccactgtgcccggtgaagagggacatagctttcataagggtcataaaggatttaggcctccccttctgcagcgtttaagtgcctgaggccagggaagaggtgactggattattttgcagagaaagctggggcccaaggggagggagacaggaattggaaaagggtaggaatgggggaggagatgccagatcagccctgagaacctctttacccatctcaaagacttgggacactaatgggaaaggctgggctaacttctgctgcccttccccactgtctgtccaggggaacctgggaaagacaaataggagctgaatccttcactgaaagccccgtcatcgtatctatgggttgggcattaggaacggcctggccccacaaatcacacaactggggtgtagaacaaaatggttccacagatgacaccaggctggtccagggccgatgcaggccagaaccccgctgggaggactccccagaacaggcactgagctgaggaaaggcaggacacgtggtctgctaccgaccccaccagatcttgctgggactctgggcagctccggagtaagagcagcatggtgagtg

SEQ ID NO: 250 - DNA, 10000 bp, Homo Sapien
  misc_feature 394, 395, 396, 397, 398, 399, 400, 401, 402, 403, 404, 405,406, 407, 408, 409, 410, 411, 412, 413, 3583, 3584, 3585,3586, 3587, 3588, 3589, 3590, 3591, 3592, 3593, 3594, 3595,3596, 3597, 3598, 3599, 3600, 3601, 3602, 3603, 3604: n = A,T,C or G
  misc_feature 3605, 3606, 3607, 3608, 3609, 3610, 3611, 3612, 3613, 3614,3615, 3616, 3617, 3618, 3619, 3620, 3621, 3622, 3623, 3624,3625, 3626, 3627, 3628, 3629, 3630, 3631, 3632, 3633, 3634,3635, 3636, 3637, 3638, 3639, 3640, 3641, 3642, 3643: n = A,T,C or G
  misc_feature 3644, 3645, 3646, 3647, 3648, 3649, 3650, 3651, 3652, 3653,3654, 3655, 3656, 3657, 3658, 3659, 3660, 3661, 3662, 3663,3664, 3665, 3666, 3667, 3668, 3669, 3670, 3671, 3672, 3673,3674, 3675, 3676, 3677, 3678, 3679, 3680, 3681, 3682: n = A,T,C or G
  misc_feature 3683, 3684, 3685, 3686, 3687, 3688, 3689, 3690, 3691, 3692,3693, 3694, 3695, 3696, 3697, 3698, 3699, 3700, 3701, 3702,3703, 3704, 3705, 3706, 3707, 3708, 3709, 3710, 3711, 3712,3713, 3714, 3715, 3716, 3717, 3718, 3719, 3720, 3721: n = A,T,C or G
  misc_feature 3722, 3723, 3724, 3725, 3726, 3727, 3728, 3729, 3730, 3731,3732, 3733, 3734, 3735, 3736, 3737, 3738, 3739, 3740, 3741,3742, 3743, 3744, 3745, 3746, 3747, 3748, 3749, 3750, 3751,3752, 3753, 3754, 3755, 3756, 3757, 3758, 3759, 3760: n = A,T,C or G
  misc_feature 3761, 3762, 3763, 3764, 3765, 3766, 3767, 3768, 3769, 3770,3771, 3772, 3773, 3774, 3775, 3776, 3777, 3778, 3779, 3780,3781, 3782, 3783, 3784, 3785, 3786, 3787, 3788, 3789, 3790,3791, 3792, 3793, 3794, 3795, 3796, 3797, 3798, 3799: n = A,T,C or G
attgcctttgagattgtgcaaaagataggatgtccttcgttgctggaaatgtttaacatagcattggaagttctgaacatcactctgcgggcagaagaaaattaaggctgtgtaaaatgtaggaagacagatagtgactgcagatgaaataatctaaatactggacaagactgcagccactgcaggcccaaagcctgggtttaaatccaagctttgcactttgaagctgtgtggtcttcacctctcccggtgtctgattcctgctctgtaacatgaaataaataagaaccaacctccagatgtaaataagtgaacacatgagaagcacttagaatagtgcctagaacatagtaagcaactcaatgaatgtcatttctcattacatttgttaatnnnnnnnnnnnnnnnnnnnnccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgatatcagataatcggggaacaaacatgacctatagcgagagagggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatgctcaaagagcccctggtgaagtgtttctctttcccactcttcacccctaacttgttacctcgtcttttccactctgtccctaatacacctataggatgactcataggagcccctggacccggggatgctgtcagatcgcttggtctttgagacaatggtgccattaaggacccccgccaggcccaccagcaggccgagggcacagaccagcatctccatggtctcaggcacctggattagttcatggacctctggggcaccaagggaagacagagttataaggtacagagagcaggggctggccttggatgtgggaggtgttgggtattcgaaaccatgagatggtgaaatttggataaagtgaccataaaacatgggattgaggaaggcaggtgctgaggggcgatgggcccaggaaataaaggtggtgccaaggccgtgagggcagagggagggcgctccataccccagtgcctgaggagaggctggtgcaggccccagtgctccccctggaggtcacaggtgtcctcggccatgggaacgagggtcagatagtggaacctgtgtaatctgagtttcttgctgggcaggaagatggtctctgcaataccctcaatgactggctccccattgcgcagccacgtgatgttcagcactggtgggaagaacttgtcaacatggcagacgagggtgttgggctggcccagatccacaggctccttgggaaagacgcttacctcggtgggggctccaaaaggggatagaacccaaggagcctactgccattggctgattcttaaaggttccaccaccccaagtcctatattcaccagattaggggccacctctcccaggcccatcctcctgctcccctagggctcctggacagggtcacagcttctcgtgctcctgacctggccccctcagcccagcctttctcttgagtaagaagaaaatgcctcctcctctgctgtcctaagaacccagctgtgtggacccaagatttctcgctctcagggaaggggctcattcatgagtgggcatcatggcctctagttctatgtgtggcagagaggccctcccatccctccagctggactctagaggaacaggcagctataggcagtgccatttgtggcccaagtctgtttggaccattgatccgggtgttcaagtgcttccttgccatgacgatgccagcaatacccctctgagaggaacaggcagctataggcagtgccatttgtggcccaagtctgtttggaccattgatccgggtgttcaagtgcttccttgccatgacgatgccagcaatacccctctgagcaccaaagtcaaaggtgtgaataaactctggtagaggccagaccatctccttctcatccaggttcacgtagaactgctcctcctcatcaaattcaaacatatactccccagagggtctgtgcgtctgcacaaactccgcatatgttgacacatggtctgctgcatgaaggagaagatggagaatgggtgaatacgtaggatgctacacagaatgcaggaagcaaacaggtaacaggaaggttattgggaacatgaaggaataacacagaaaatgagaaatgcaaatgaaagaaaagaaaaggagtgagaagaaacaaagacagaaatgacccatggacgatataggttgtttcccttgtccctgaagacttaacatccgtctatgataatggtaatgctgaatacagtaagataatatttattgggcacttactatgtgctaaacttactcattgaatcttcacacccccatgtagaagaacttattttccatagtagggaactgaccccagaggtaaagtaacttgtccaagtcacacaactcctggtagaaacaatattgagtagtcctcctacctcattcctgtaggatctcagaaaccctacaggacaatacattaaaaattactgatatagccataaagcaaggcagggaagtggaaggatggaataaatatttcagagtggaacaaaatcgtgaaggacatgaaaatacctccagagtcttagtgacatttatagacttcaagttacattcttacttttagaagaaaaatgataccttctataattttatccacaacacttacattttaggcagagtaaatttaaaagtattatcattcacataacattcacaaaattgtcttgtggagtgtagttttcaagtgtagtttcacctggaaatacaagttgttggcatttgaaagacctatgggatagtatcttagctttacctgatacataagaagcagcaactggttgataacaaaaagtgaattattattacagtgaattacagagagtttagggttcggcctggaagaggaagtgaagccaaatgacactgcatggttggtggtccctaagtgaggatttcccctcccagcccagcatggggagaaccagtcctctacttagatgcatagtgtgacagcaggttcagtgccgcacacggatggtgagggtcccccactgagtttagggtctagaggattactcacctacagaaatgaatcccaaaggaaaaagaaaaatacatggtgtatagactgggctacacagatgtaattggttcagcttaggttactttgtatttattatatttacaaaatctgaaaactaaaggttggcacattttgaagcaaattccacacttcaaatgttaattttcattcagttaataaatgctttttgtgaactttcactctctaggtaataaggatgaaactctaaagatgggaactttgtccttaatctacttgaaattcaagaataaaacagacaaagaaaagatgattgctacatgtgtggtttgatcaccactgagtatcacaaggtatacacaagagctactcaggagcaaaattaaaatacgatttaggaaaggttcctagggacagtgttcacctgcagatagcaaaacagagaaaggggaaatggcatttccagcaggagaagcaggctcaggagcagagaggcatgaagttgcaaggagaactgcagttcttcagtgtgactgaagccaggggagatgtgggccaggcagcactgtaacctgccttgtgtgctgatggcaagtgtttgcattttatcccacaggacataggaagttgtgaagtatcttaagcaggagagtaacacggtcagatttgtgtttggatggggcacctgtaggaaggatgggctggaggaggcgggactcaaggcaagaccagtagcacttttaagccctctggtgggaagtaatgaaggcgtaggccagggcaggaacatggggtgaggaggacagcagatggatttgatggcagtaatgacatgagaggccacaggaatcactaaatcacatgccagaagtagggatatgaagaagtcgagaataaccacgcaacgtggagaattgtggcatccgtgcctgcaaaggtgataattaagtgattgagagaaggtaaaattttctgtttgagacatactgaatttaaacttctaggggaaaacatacagttgatttgaaggcagtgaaataaatggatgagtgtcatgctacattaggttagtgacataaactggaaggaggctcatggtgggtgaagttctaattttgggtcaggtcactcaagaaaagtacacaaagtcaggatagcagggatctgagtgtgtgctcctgcatccagacaaacacagacatgaagaaagaggctgaaaagcagaggactagaaattggtaggaaaacagagaggaagtgggttcataaaagacaagagacaggagaaaacttccaggaaagaggagagggggcatctcaaacacactaatgacacacataagacagaaacagaacagtgaccactggcttgagttgtataaaagtcattagttgccaccctgagaggagcatcagagatgagggaaagaaaaagagagagtacattgggttgaggactgaatgaaatgggagaaaatcgataataggctgggcacagtggcccatacctgtaatctcagtgatttgagaggccgagacaggaggatcacttgaggccaggagtttgaaagcagcctaggaaacatagtgagagtccatctctaagaaaacaattttggattccctgccttccatgagcaacacagcaaacataagctctgcagatgtgctcagacttgagcctgactcactgaagagagtgtggtgctgccaggcctcagacaccagattataatcaacctcttcccaggccctgcacaggagaggcccactctgtggggcatacagtgcccaggggtggtacaggccctgcagagaccacagactgttcacctgacaagaaatatcttgaggaactcacttcacagatccctcaagaaaggaaccactgcaggagaatacccagaaaatcgaaagaattcacagatccttttaaagaagggaggggccactgcaaactccaccagacaagtgaaaaactgtgcgttcccaaagcgtgagaggggaaaaacctgcctccggacccatgtccccactggggaactcgaaaatccagattacaggaaaaggatttaactttacctagacctgaaacagatttagcatgaaatacaaaagtacgccgggcgctgccgctcacacctgtaatcccggcactttgggaggccgaggcgggcggattacaaggtcaggagattgagaccatcctggctaacacgatgaaaccccgtctctactaaaaatacaaaacaattagccaggcgtggtggcgggcgcctgtagtgccagctactaggaaggctgaggcaggagaatggcataaacccggaaggcggagcctgcagtgaaccgagatcgcgccactgcactccagccctgggtgacagagtgagaactccgtcgcaacaaaaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 251 - DNA, 201 bp, Homo Sapien
gcctagggagagccctgctgaagactcaaactgggtgaataaggtcttcaagaagaacaagcaaaagacaagtggcaccagaaaaggcttcccaagacatycgggatccaaaaaaccaagcagcaaagtgcagtgagcatgtctaatgttccttaaatcccacggagaggagcagctttgggaactgtgttcagagagatt

SEQ ID NO: 252 - DNA, 201 bp, Homo Sapien
aatgaaaacaccagactagactgaaatatgtgggagcaaggcagttactgacagttgataccttaatacttattcccattatttttctgtttgacataggygatgctcatgcttttgatgaggagtggcaaagtgaggttttgaagtacaaaccaggacgacacaatctaggaaacactagaatgagaagtgttggccatg

SEQ ID NO: 253 - DNA, 201 bp, Homo Sapien
agaaggcatgctctttatggatgacctataaatttctggccctaacagtggcattttctcttaaccggcactgtccaatggcattttctgaaatgacttcrgtaatgacaaaaatgctatatatctattctgtccagtgtagtaatcactagccacatgtggctgttgattcacatttgaagcattgctggtacaactgaa

SEQ ID NO: 254 - DNA, 201 bp, Homo Sapien; identical to SEQ ID NO: 123

SEQ ID NO: 255 - DNA, 201 bp, Homo Sapien
cccacctactattctactctttatgagatcaacttttttagattccatatatgaatgagatcatgtagtatcaaattcatcattttaaatattcttctgtrtcatcaatttttaaaatattttcccacaatacttttgctcaccatccactttttgtaccccagaccgtccatctgagatcttttttttttccttcctgaa

SEQ ID NO: 256 - DNA, 201 bp, Homo Sapien
caaagagcaaggtggcagatccttaccgtgaggatgacgtcacccacaagggcattctctaagacccttgtgctatatggatcttgggggaattggggccrgtgttcattgacatcagtgatgttgaccatgactgtggtcacgtcactgagggaagaggagctcttccggctgcactcaatggacaggaagtacttgggg

SEQ ID NO: 257 - DNA, 201 bp, Homo Sapien
gtcaccaccagaagcctagcacagctctcacctggatctgaagctgataccattcctgagccctcctgcttaggccctcagcagtcaccagccatccatcyggggtcactcggaaggcagagccgttgttccccttggtgattcgaaacgagtagggggggccattctctggagaatctgggtcactcaggatcagctgca

SEQ ID NO: 258 - DNA, 201 bp, Homo Sapien
ctccaacagtgatgaagatctccagtgggagagcagaaggtgcatagtggctctgctctgtgacatggacacggacagacgtcgaagacgagaggggaggkatgccactgtctgacgcctgtgggcaaaacaaacactgctgtcacccaacagaactgcagtgctcttgcgcccgactgaggctgggcctccttgtggagc

SEQ ID NO: 259 - DNA, 201 bp, Homo Sapien
tcttacccaccatgccaccctggaactcatcctctccaacagtgatgaagatctccagtgggagagcagaaggtgcatagtggctctgctctgtgacatgsacacggacagacgtcgaagacgagaggggagggatgccactgtctgacgcctgtgggcaaaacaaacactgctgtcacccaacagaactgcagtgctctt

SEQ ID NO: 260 - DNA, 201 bp, Homo Sapien
aggtgttaaaatcacaggcagactgtgaccttccacatgacataatccaaataactgaatgattattacaaaggaaatttatttttcttccatgtgattcsatggggtttgagcacccccagtggtaagcaatccccccatccctgggaaacactggcctattactcagcaaaaatgataacggcaccagggctagttgac

SEQ ID NO: 261 - DNA, 201 bp, Homo Sapien; identical to SEQ ID NO: 130

SEQ ID NO: 262 - DNA, 201 bp, Homo Sapien; identical to SEQ ID NO: 197

SEQ ID NO: 263 - DNA, 201 bp, Homo Sapien
acaggaataggttaaacagaaaggtagggagccttttctgggaactctaacacctccggtgagttctcaccttaccttttgttagagaggagttgggaccrttcatgctgggagtcagatgtctggagaaatggcttcgtgtgatcgagtgaattcactgctggagaatttacctgttggccccagaaggagtttcacagt

SEQ ID NO: 264 - DNA, 201 bp, Homo Sapien
tttgttttgttaactctgtctcaggctgatcatctcctttcttcacagagaaaagtctgatgatcccaggaaacatcatttctttaaaacgatcaactttmctcgcctggaagctggcctaattgaacccccatttgtgccagacccttcagtggtttatgccaaagacatcgctgaaattgatgatttctctgaggttcg

SEQ ID NO: 265 - DNA, 201 bp, Homo Sapien
cttttctccaaaatgtttttcattttgtttgtttttgcaaatatcttagattactaggaaagccaagtctctcttcctggatttcttctcctataaaccgyctattgatacctacccacttctctatggagcacagatgaaggatattggtcatgtatgttgaaatatttgtccaactttatccctagttttttgactttg

SEQ ID NO: 266 - DNA, 201 bp, Homo Sapien; identical to SEQ ID NO: 135

SEQ ID NO: 267 - DNA, 201 bp, Homo Sapien
ccactgcacttcagcctgggtgatagagtgagaccctgtctcaaagaaaaaagaaatttaacttactttttgtataatttcttcaacagcaaatttaaggygatacttatgtcctcttcctggaatatcctaaaattaagaaaatgtagtggagacaagaaaatattataacaacattatacttgcattgttagaagtatg

SEQ ID NO: 268 - DNA, 201 bp, Homo Sapien
tgttagttttctattgctgacttaagaagttaccacaaacgtagtggcttaaaacaacacaaatatatacttttatagttctgtggatcataggctgatarctgttctcaaagggctaaattaatcaagatattggtaatgttgttttcctttctggaggctctatgggagaatttctctccttcttactcaggttattgg

SEQ ID NO: 269 - DNA, 201 bp, Homo Sapien; identical to SEQ ID NO: 148

SEQ ID NO: 270 - DNA, 201 bp, Homo Sapien
cttcctatgggttttctgtaacataaaataagacataattgatcacggaaggcacaaccacattcactgcattcacaaggtttctgtcctgtgcaaatccwctgttatctcctgaggctgcacatctgaccactggctgtcccacaaggactacgttcctgtttgcgaggaggccgctgatgtttaatgatgtctgagggg

SEQ ID NO: 271 - DNA, 201 bp, Homo Sapien; identical to SEQ ID NO: 140

SEQ ID NO: 272 - DNA, 201 bp, Homo Sapien
aaaagcaagatgcagaacaatatgtatagggataataaattttctggaatgatccatgagaaggtgataaaaggggttacattaggtagtggaactggagygaggaaacttcattttctaccctttggttctatatgaaaggttttgtcatattacacatattgctttttaaataatttaaaattagtttagaacttaaaa

SEQ ID NO: 273 - DNA, 201 bp, Homo Sapien
ttctttaatatactctcatcatggtatctgtgtagagtcatgatctaaaccctgtcccagatattccttatcggattttaaacttttaggactgcttccckctagttgtgaaatcattgtctcccagaattaacaggaaatgactgcatgacaacaggccagggatgctgccagtttatccaattaactactagtagacac

SEQ ID NO: 274 - DNA, 201 bp, Homo Sapien; identical to SEQ ID NO: 141

SEQ ID NO: 275 - DNA, 201 bp, Homo Sapien
aatcctgatctcaagtgatcctcctgcctcggcctcccaaagtgctgggattacagcaggcatccctttaaatgcatgccttctgtgaacagcacttccastactgacttagagagacaaaaggtcttataattttcggtccactaggttataaattatcaccttcacttgtaaggtagtaagattaagatagttaaaagg

SEQ ID NO: 276 - DNA, 201 bp, Homo Sapien
gtgcttgaagtttctccagtgagcaagtctactcaccaggattggcttcaggatgtccatgttggaacgaagtactcgctctgctgcagccagtttctccyttggtaggccacaaagctcagaaacttcttggtcaccaagttgaatcatctcttctgattttgatccattgcacagacttgtcaaatgtaactggtagcc

SEQ ID NO: 277 - DNA, 201 bp, Homo Sapien; identical to SEQ ID NO: 267

SEQ ID NO: 278 - DNA, 201 bp, Homo Sapien; identical to SEQ ID NO: 268

SEQ ID NO: 279 - DNA, 201 bp, Homo Sapien
gattataatttgagtcttttcctactataactgagtactccatttttctaagagaaagagaatgagttacttaaaaaacaatttttttcttttctctttcmgcctttttccctgttctctacttcctgcttagctctttagaaatggaatcataacttttaccttcccttttaccagacactccctgcatggcaagcttat

SEQ ID NO: 280 - DNA, 201 bp, Homo Sapien
tttgcttcaagatatggaagtcatggatcctcatttttgtcttgtcactgagttatatgaaagtctggttgaatgtctgtcactttttctgatggagaccraagtctgtgggaatagggagattcttttaacaaccttaaggatctagatactgtatatatacctcaagctgatatattagccctgatatgacaggcaata

SEQ ID NO: 281 - DNA, 201 bp, Homo Sapien; identical to SEQ ID NO: 148

SEQ ID NO: 282 - DNA, 201 bp, Homo Sapien
ttggagaaagctctttgggagagtataatggcagcgttaaaagtcagtgttggtttctgttcccaggcactttgtttatacaaagacggagatattcaccraggtttccagtcacttctcagtgaagttaacagaactggcactcagtacttgcttagaactgccaacagactctttggagaaaagacgtgtgatttcctt

SEQ ID NO: 283 - DNA, 201 bp, Homo Sapien
tatcttatggttctggaagtcctaagtccaaaatggtacagcatagcaatgttattttctggagtctctagaagaaaatctgttccttgccttttctggcytctcgaggaggttgcattccttcatcagtggcccctatccctctgacctctgcttccgtcctcatgtctctgtctctgactctgcccctcctgcctctct

SEQ ID NO: 284 - DNA, 201 bp, Homo Sapien; identical to SEQ ID NO: 151

SEQ ID NO: 285 - DNA, 201 bp, Homo Sapien; identical to SEQ ID NO: 156

SEQ ID NO: 286 - DNA, 201 bp, Homo Sapien
ggcccactcctgcttccttggaggatcccaccagtgagtctccctgttctgtccctcccagcccgattctcctgggaacccagtcatgagatacccgcccrttccttcctccttacgggggctgattgaaggtaagcaagagatcagtctggtactggggcagcctcagcaaggcctgatgaagtgtcacgtcctttgcta

SEQ ID NO: 287 - DNA, 201 bp, Homo Sapien
aaatacaggccaggccctgtacaagtcagtggaaagttgatggtgaaaagacagacatggacccctctctcctggtgcttagtgtgttacacagtgaggcrcctgcagtggtgacaggagcatagcagcacagcaggagccagcagttaatccacaaatgttttctggagatctgaggatgagctagctagggaagaaggg

SEQ ID NO: 288 - DNA, 201 bp, Homo Sapien
tctgtctccgcaggaggcccataggattctgaagagctgtgatgggagccctgcctcggctctccatcagactcaggacaggccaccagggctgctatccrtcaccacacaccacctctcccgtttgacagtgtccaaattgcctcctcttccccacttctggaatatgtgttgagagacagcagtgagatgcaggagggc

SEQ ID NO: 289 - DNA, 201 bp, Homo Sapien
cgggtggggtcacataagttcaggtccacgccctgctcggtgccggcgccaggagagccaggaagacgcggcccggcttgcggggggtagagggacacacytgcgctgcgggaccagtctcctgaggctgcacgggttggtgcttggttaattaaatccttagtccttaggctctttatttttattttttattttttttga

SEQ ID NO: 290 - DNA, 201 bp, Homo Sapien
tgaaggctgaagacagagacgatatggcaagaggcagtggcctggaatggggactgaccaccctgcagaagttcagccaggtagatgtggggcaggggaaygctaaataaatacagggagacagagacaggggtcaagataacagaacaggcaaaggggttctgaaagcagggtgggtctagaaggacttagagggcatca

SEQ ID NO: 291 - DNA, 201 bp, Homo Sapien
tagactcttgggacctagacttctacaccaagcgcttccaggagctacagcggaacccgagcactgtggaggcctttgacttggcgcagtccaataggtgrggagaaatggggttgttcccatacctgagcccatgggtgttgggagagaccacaggggctcaccttcatgttcctcccttggcttaggggcctccctgag

SEQ ID NO: 292 - DNA, 201 bp, Homo Sapien
gtgctcggattacaggcgggagccaccgcgcccagcctccgtctccctcctaagtgacatcctgtccggcatcccgcaggccttcagatggatggggtagsagagctcaggaactcaaacacagcccgcctggtggatgacttctaagcatctttcagtctccctgatcttgccaagcagagaagggcttcctcgtaatgc

SEQ ID NO: 293 - DNA, 201 bp, Homo Sapien
gccacagacaatagagcagtcttggcagctacatggtgctgtgacctcatccacagactcgtcacagcctttggtggcattgttcatgggctccatcccayggactggaaaatctacagaaaggaattgtgttgagtacaaatctcaattaaaaacatccaaaattttgtattatacttaaactcaaagaaaagcccactg

SEQ ID NO: 294 - DNA, 201 bp, Homo Sapien
ctctagtcattgtccttcccttcagggtgttccgctctcctacccccagccagaagtcccactcctctcaccttgatagctacctgcaggggactggagtycccaggaaggccaattaccagtccctcatacacctccccaaaggcaccatggcccagggctctgcaggaagacacgttggaagggagtgggcaggcggcc

SEQ ID NO: 295 - DNA, 201 bp, Homo Sapien
tccctctacatctgctttcctgatacttctcttgggtcgttgctttgtgcttgttggggtgtccactgggtctgactgtggagagtcgcagggtattttartggttttaccagcagccactaattcctcggtgtgaccaggagtctggaagagctctttaaagccagccaggtcttctagagcctgggccttttccttagg

SEQ ID NO: 296 - DNA, 201 bp, Homo Sapien
gcagattaacaagttaactctcttcactgtaaagcaccttccagctttctatgtatacgctgctctccagggtaaagacatgcatttgacatttccacacytatttcatgcaggacatgtgatcccaaaaattagcagagacttgtctttgcaagccaaaacagctttatcttccctgaacactaagaccccagaagggtg

SEQ ID NO: 297 - DNA, 201 bp, Homo Sapien
tggccctctttggtcaacattctgcctggacatgtcagcacgtacacagcttcctacttctgtttaatggctgcttggcattccacagtataaacataacraagtctggagagtcacctccacctccccagtgacagacattaacttctttccacatgctgcaattctataattcaactgtataatgaatactcctgcatg

SEQ ID NO: 298 - DNA, 201 bp, Homo Sapien
aaacattagaaacaaacagctgtttcttgccttaaatcgccaataaaataacatggattatccttatgtggttagggtccatattacacaggaaatatttrcctaccgcaaacatcttcagggtagcaagctgttccctctgtgacaggaatacagtgaccagtgccaaatgagagattagacagattctcatctcccatc

SEQ ID NO: 299 - DNA, 201 bp, Homo Sapien; identical to SEQ ID NO: 172

SEQ ID NO: 300 - DNA, 201 bp, Homo Sapien
cactgtccctatgacttctggttcttattttcttgacacacacattgtcctcagcctgtgtgggaagaaaaaaaatagaactcttaagtaatttaaacacycatttttagaatcgacctcctctgcaaaaccccaaaggcttactaggtattatgcaggtccttagttgcagaaaattaattttgaggttggaaataagtt

SEQ ID NO: 301 - DNA, 201 bp, Homo Sapien
tgtattctaatgtcagactaaccaatcagatttgcttccgaagcaccacttcttcttttggaacatatcatctgtaaaatatcatgttgacttcggctgakagacactctctttgaaggcaggttgccactctttctccctcctctcttaggaacctctgtctgagatttgctgctggaagcaggggctgttttgcaggac

SEQ ID NO: 302 - DNA, 201 bp, Homo Sapien
aaccttggcccagactccttcacaaagcccccggtgttcaactattctcagtccaggagcccagcagtgctcccagtggagtttatgaagccgattcagasccagcaaatccaaagttttcttcccttaagcagactgacagccttacttacagaattcacttgtaatttatgacaaaaactgcactagaacttatcacaa

SEQ ID NO: 303 - DNA, 201 bp, Homo Sapien
gtgaaggcaggcacagacggtgcacacacatggcccattgcttccccgaccaacctggaatccaaaggaagaggcaggcgagcaaagcgggctgtacagakgagggggcagaggtgcttctgagaggggtatcggacggtgctcagggagcctcaggggccacctagcgttgtgttacctccaaagcagtgctttctcgga

SEQ ID NO: 304 - DNA, 201 bp, Homo Sapien
gcccattgcttccccgaccaacctggaatccaaaggaagaggcaggcgagcaaagcgggctgtacagaggagggggcagaggtgcttctgagaggggtatyggacggtgctcagggagcctcaggggccacctagcgttgtgttacctccaaagcagtgctttctcggagtaacagagggcgggcccagagccaaatagct

SEQ ID NO: 305 - DNA, 201 bp, Homo Sapien
aaaaggggggaaaaagcaaaacaaaaaagaaagaaaaaagaaaaggaggcagaaatcacaactaatgcacttcaaagggaggaggggaagtgtcttttggrgaatgggaggccgcttttaaagagggcaaggcgaaaaatcagcaaacatagtcgcgcgggtgaccgtccttgtgccttgcgtttttaaaaagccgctcct

SEQ ID NO: 306 - DNA, 201 bp, Homo Sapien
caaagcctgtttctcagcagccagtttctgctcttgggtccttacgggccgtggaaacttaggcaaaactccaccaggccagatggactcctgaagaagcmggaggtactgcacccagcgctgtggacttgttaaattagctacctgcacctctagccacctgtggtagaagagagacgaaagcttagataaagctgaagg

SEQ ID NO: 307 - DNA, 201 bp, Homo Sapien
aggtagtcaataaaagctttctgatactctcaaggcatttttcatccctgtaacccctgtaacagagaatctatcttctcttacggctgcagattccctgracactattcagcatcacatccaccttctctgcaacttgagattctgatgtgagggagaattcagcagtcttacctttgaactagggtcccaaagataaga

SEQ ID NO: 308 - DNA, 201 bp, Homo Sapien
acatttctgacttcagagaatatctcaactacctgtaactgcaggaccaacatctcagatatttttgcctcacattctctgggttttggttcttaccacaytgccttcctggagacaataaagaatcttgtcttgtgcttcagtcacacttagtgctggagaaattttactggatgagaacctcagcctagacctggtaca

SEQ ID NO: 309 - DNA, 201 bp, Homo Sapien
gaatcttgtcttgtgcttcagtcacacttagtgctggagaaattttactggatgagaacctcagcctagacctggtacagaaacaaagagcagaaacaggwtgtaatttatggccttgagcctcacactaagggctggcaagtactgataataaaacacaacaagaatatccatacttattctggggagcttactgtggtc

SEQ ID NO: 310 - DNA, 201 bp, Homo Sapien
agaaagctgcctggagtcatgagcatgatggtttctttgcccagttcagacagcggagactccagctctgagtcttcacataagaacaggggacctcgaasatttggctgtaggaaatgagatgagttgtttcctacttttctttcttcacacatcccacccaaatctccctctacagcttcgtggccttcttcaacctct

SEQ ID NO: 311 - DNA, 201 bp, Homo Sapien
atgggcagaggtagcctacttgcccagctggagaagagaaggtaatctaccacgtggaaggaaggacatgaacaaaaaaatgaaagcaggaaggaacatgstggtttgggcagaataaaaaatccctagatttttttggaagtttctcgtctaacctcctgcctaaaccatctataatacattctgtccccaagaaaatgc

SEQ ID NO: 312 - DNA, 201 bp, Homo Sapien
tgtccaaaatagccaacacgatcgtatttgttattattagggccgcatctcctttttatagggcttttcattcagtgagcctaagatgcctgatgaaaggratccagtagcaagaattcctgttcctgtttatgtaagagggtcactagagggaggtggctgcaatgacctgatcggcttctctgcaggggattaagtgac

SEQ ID NO: 313 - DNA, 201 bp, Homo Sapien
caatattatcagcatgatctcatcctgctggattagaacttcctgtgtttgtgccctgttctgctgcttgattccgctgtggcaactatgtactactcatytctgtgccccaacacagcacctccaacactggagttcaacacatggcatgctcagctgaatggaacagaaatcaaagttacaaactccaactaccccaag

SEQ ID NO: 314 - DNA, 101 bp, Homo Sapien
matttttttcaaagtgatatggtcagaagtgaggttcaaggctgttgaggcctccccttcacccacctcatttaagactgacatagctgtgtgggtcatgg

SEQ ID NO: 315 - DNA, 201 bp, Homo Sapien
gaaagatattaccccatctttttagttatgcttctcaatctgcaaggtggaaaactgtgtgagtcattcttgatttgtctttttctcaaccctaatccaayaccacataatcatttaaatagtcactaaatataggtgatcctacctcctcaatatctcatgaatctattacccctttaccatctctatagcaatgatctc

SEQ ID NO: 316 - DNA, 201 bp, Homo Sapien
acagtacaggcttctctgggtgcatcattgatttttatataaatcagagtagatactaatctattactttagtaagcaacaggattttaaccacaaccccratatgctgttcagaaagatattaccccatctttttagttatgcttctcaatctgcaaggtggaaaactgtgtgagtcattcttgatttgtctttttctca

SEQ ID NO: 317 - DNA, 201 bp, Homo Sapien
gaacctcagcctagacctggtacagaaacaaagagcagaaacaggttgtaatttatggccttgagcctcacactaagggctggcaagtactgataataaahcacaacaagaatatccatacttattctggggagcttactgtggtcagagctgccaggaaagactcggccctgcaatcccccaaacaatgtatattctggc

SEQ ID NO: 318 - DNA, 201 bp, Homo Sapien
gaagatgagtaacaataagaatcgtgttatttatggagcgttcactatgtgccatctaccgtacaagaagttttacagaacagaacactaaaagggcctcsgtctctgggtgagcctgcacctataccttcccaactctcctctggcaaggctgcacctattatctttctagctctcctctgatgggaagcattataacct

SEQ ID NO: 319 - DNA, 201 bp, Homo Sapien
ctttggccccttcaattaattaatcctccacagcactatttaaatgatttttctcaattgcaaatttgctcatgtcatcatctgtttatgttttgtaaaaytgtttcctatcaaatgagtgacaaatgttttgttcttggaatgactcacaggagtctgaatgagcagactccctttaaactcttcactgttatcatcagc

SEQ ID NO: 320 - DNA, 201 bp, Homo Sapien
ttttgttcttggaatgactcacaggagtctgaatgagcagactccctttaaactcttcactgttatcatcagccattattcttgcatatcatatattcctwatcaatcatactaacttctttgagtaccacaaatacactatattgttttactgctctgccttgaatgttctctctctctctcactgtccgctggcaacgc

SEQ ID NO: 321 - DNA, 201 bp, Homo Sapien
tcagccattattcttgcatatcatatattcctaatcaatcatactaacttctttgagtaccacaaatacactatattgttttactgctctgccttgaatgytctctctctctctcactgtccgctggcaacgccccacattctttaaatctcatctctgatgtcatctactataagccttccctgcacctctcataattga

SEQ ID NO: 322 - DNA, 201 bp, Homo Sapien
ggtcaggttacctttctaacaaatgtagaaagagaaaaagacacttggggtctgtgtatttttaggataaataagactgattgtaaagggaaagctctaamaatttctatatttgagtattgtgacatgtttaagatttcattctgaaagttttttcttttttttttttttgagacagtctcattctgtcgcccaggctgg

SEQ ID NO: 323 - DNA, 201 bp, Homo Sapien
tgaaactcctgacctcaaatgatccacccaccttggcctcccaaagtgctgggattacaggcatgagccactgcgcccggccaatctgaaagttttctatrcacaaatctagtgtgcctctgaagtctttcaagtcaacctttttttggccccatactatgttgctaccgacatactataatccagttctgagaaaatcag

SEQ ID NO: 324 - DNA, 201 bp, Homo Sapien
ttgcacaccagcctccctcccaggaaggctgaatcctctccgagaaatctttcggggccagcattatattagagctaaagtatatttcccaccaatttacycaactccctccctgctccagtaccaaatagctctacttctccaaagggcacttggagaagcctgcaaggacagaggtaaagatcaaaagtaagcaataac

SEQ ID NO: 325 - DNA, 201 bp, Homo Sapien
gggctattcagcactgacaatctccatcttagtgaatacataatgtataagattttaggatcacaggagaccctgaatataggtccaagtagtttatacakaatattaacaaaattcttgcaattcagatgtctagctggtctcatcaccacagactctgttctgctcactctgttctgaatgaatcagctccagcactga

SEQ ID NO: 326 - DNA, 201 bp, Homo Sapien
gacctataactgcaaaacaaacaggtcttcctcaaaggacagtgaatggtattgtttaacctgcagcgccacctggtgcccatagagagaattcctgtgcycacgccatgcagcagcagtttggtaggctttttgtcacctatttgaaacaataaaagcaacacacattcagaaagaagctggctaaaaatattccaggtt

SEQ ID NO: 327 - DNA, 201 bp, Homo Sapien
ttttgacacaggtctgatgccatcgttggggccatggggagggcagcgccgcggacgtggcattcacgcattctgctgctggcatggttcctatttttatygtggcattgctctgggtgtccaggcagggcgccggtccagcttctcattccttcactttccatcaggactccacaccaatcctaccccttaccttggctg

SEQ ID NO: 328 - DNA, 201 bp, Homo Sapien
gctaaatctgattctgatgtttgcagagatattttcaagtttcttctgttttcgggcatgagcagagtttgcacaagccggatttgctccttggctcagastgctacccgctctccccttcccctccctttgtctctcattccaaataaggagtgcttcttgttacataattggatgttcccagcacagaagctgacacat

SEQ ID NO: 329 - DNA, 201 bp, Homo Sapien
tcattcctctacctcacagcttcttttcccaaaggaaacaggatctactcaccagcaacaatcccaacatcacaaaaggaacagggaaataaacgtgcatrcaactgggacacacagacccctgtcacctgctacaaatggagcagaagtgggagagaagtgagccaccgagaacctaggccttcttagctgtagcctact

SEQ ID NO: 330 - DNA, 201 bp, Homo Sapien
tttttaagctgtaattcaatttctaagacacactttattatcactcactatgcctttcttaagttgtaaatggctgtatattcagggatttggtatacttwgccttgcccaacacctggatggaaccaactgccactggttcttgagagcaatgaagaaggtggagatttcttcatccaaatatctttcctctccctttca

SEQ ID NO: 331 - DNA, 201 bp, Homo Sapien
gctcccagactctgccgcagctctcctgacctttcctaggagatggtttagagagagacatcttctctaagaaagtgattccaaggtctggtgtaaggtcyagagcttgccatcaagtttctcctgggtgccctgcttgttggactccttaaacctgcacaccctttcttttcttcttcctctctggatacttcctaactt

SEQ ID NO: 332 - DNA, 201 bp, Homo Sapien
caatccaagggcaattatgctccaaccttaagataccaaatacagttcaaaggaaaagagaaagaaaaggaagatcaagttaaagcttctatcatcctaartacaccttcagtaaattagaagtattgacttattttattaccctgagagcagggttttcaacgttggtactactgatattttggactgcgaaatctttgt

SEQ ID NO: 333 - DNA, 201 bp, Homo Sapien
ttcaaaggaaaagagaaagaaaaggaagatcaagttaaagcttctatcatcctaagtacaccttcagtaaattagaagtattgacttattttattaccctkagagcagggttttcaacgttggtactactgatattttggactgcgaaatctttgtcataggggctttcctgtgcattataaaacattccacaacatcctt

SEQ ID NO: 334 - DNA, 201 bp, Homo Sapien
tcaagttaaagcttctatcatcctaagtacaccttcagtaaattagaagtattgacttattttattaccctgagagcagggttttcaacgttggtactacygatattttggactgcgaaatctttgtcataggggctttcctgtgcattataaaacattccacaacatccttgcccctcctcccctcaaactagatgctag

SEQ ID NO: 335 - DNA, 201 bp, Homo Sapien
atgaagaggagaaagggaagaagatactaaaatcataaaacagaaaatattcataagatccacaacaatattctaaacaaaaatgcctggtgcagtctaartataaggaaaataacaggtccattccttccagcctatttatctattggctgtacctctatagacaatccaagggcaattatgctccaaccttaagatacc

SEQ ID NO: 336 - DNA, 201 bp, Homo Sapien
agagttttggctggtgcaatcagacagtgcttcttgaaaatggaacttgaattggtccttatgggcagaggtagcctacttgcccagctggagaagagaargtaatctaccacgtggaaggaaggacatgaacaaaaaaatgaaagcaggaaggaacatgctggtttgggcagaataaaaaatccctagatttttttggaa

SEQ ID NO: 337 - DNA, 201 bp, Homo Sapien
ggaaataagaagctattccttgtaagtttgctaatcttatctgttcagaataataaaagttctctgtcaaagacttaggaagggagatttcatcccccagscttgctagtcctactctttgtgcattcttaagacaggaggcaagtgctttccattctccttggaaaaactgaggctgaatatgcagcttgtcatgcagtt

SEQ ID NO: 338 - DNA, 201 bp, Homo Sapien
tgcaaatgcaatgcacaggcacacggctgtcagctgccatccacctgctacaatctcaaagatatattccagtagagactgtcgctatgtgacaggaaagscatgatgtcttcatcctaagatgggtgtagaataagtgatacccaagaaatatgacaggcagaccactcatatgacaggggaaactgctagggcccatcc

SEQ ID NO: 339 - DNA, 201 bp, Homo Sapien
catgatgtcttcatcctaagatgggtgtagaataagtgatacccaagaaatatgacaggcagaccactcatatgacaggggaaactgctagggcccatccyggcccagtctatagaagtcaagagcttccctttggcatggcctaatggaagaggcctgggacaagcagtactccttcccagggagccacagtacaatctg

SEQ ID NO: 340 - DNA, 201 bp, Homo Sapien
gggagccacagtacaatctgagcaaagccatcaatgagaaaaattaatttcagcacctctaaaaacagcccaagccaatgactggagagccagaaaataascgagaattctgaagactgagcttgagttaattttgtatgtgggggtcttgcaaaagtatgcgtatttctagaaaagctgtgcataggaagagatggggta

SEQ ID NO: 341 - DNA, 201 bp, Homo Sapien
aaaattaatttcagcacctctaaaatcagcccaagccaatgactggagagccagaaaataagcgagaattctgaagactgagcttgagttaattttgtatktgggggtcttgcaaaagtatgcgtatttctagaaaagctgtgcataggaagagatggggtataagacatagccaggcatcagagctgaactggaagaaaa

SEQ ID NO: 342 - DNA, 201 bp, Homo Sapien
cttaagtggaatcttaaggtgtggttgttacgacttttatgattttgggaacgttattttatctgaatgtaattttcttcacttatgaaatgtagaactayatgtctatctcatagaattgaacattaatataaacagtacatagctgctttcctggtattaatattgtaataagcgtcagttcctttcccattgcaatta

SEQ ID NO: 343 - DNA, 201 bp, Homo Sapien
tctcatagaattgaacattaatataaacagtacatagctgctttcctggtattaatattgtaataagcgtcagttcctttcccattgcaattactcgtgcmcttttggtggcagacctggaggttctcttaagaaataaccaatgtcacaaagaactgttatccacctgctagttagacatgcccaccaagaaagaggccc

SEQ ID NO: 344 - DNA, 201 bp, Homo Sapien
ctggtattaatattgtaataagcgtcagttcctttcccattgcaattactcgtgcacttttggtggcagacctggaggttctcttaagaaataaccaatgycacaaagaactgttatccacctgctagttagacatgcccaccaagaaagaggcccttgaagtagagttccacagaaagcgccttgattctggagcgttct

SEQ ID NO: 345 - DNA, 201 bp, Homo Sapien
tgattctggagcgttctaagagaacagtggaagcaagagggttcatggtcaacctttcccaactgtccttaggggaggtggacgttgcgccttgcagcacmgcactctccagtgctcccagactctgccgcagctctcctgacctttcctaggagatggtttagagagagacatcttctctaagaaagtgattccaaggtc

SEQ ID NO: 346 - DNA, 201 bp, Homo Sapien
ataaagaaataaatgcatattttaaacagagtggagccccttttcaaacaaagcgttacctagagccccagtatattaaactgatcaaagtgtaacttctktggttgggtcatggtccactcagttttccctgagcttctaagttggcttcagaagcacttctgcagaaccctagaactctaggaaacataatggaaaaac

SEQ ID NO: 347 - DNA, 201 bp, Homo Sapien
aggcactcattaaaaatttgctgaagattaaacagacaggtggcatagagcaagttttcattattgctattcatggtgtatcctttttggacatccatttwttccccttgtgttccaaataaaaccagaaaaggaactgcaagtgataacatcaatgtttcaagggacagagactcataagcagaggtatcatggtcatcc

SEQ ID NO: 348 - DNA, 201 bp, Homo Sapien
tggactccttaaacctgcacaccctttcttttcttcttcctctctggatacttcctaactttacacacttcacgctcccctctgccagaacctttcccccyggctttctgccaagccattccattcccacatgcccccaacactcacacacacacactctgtctctatcttacacacacacacacagacacacacacacac

SEQ ID NO: 349 - DNA, 201 bp, Homo Sapien
cgacctgtgggctggacatcattagaggtcatatcatctgttttgttgtttgtgataacataaaaaggcatctcatgtttggagacacttgtttcgtatgyatgtacatatatatgtatatatcagatctgcgtgcatgcatatgtgtgtatgcgcctgtgcctatgtgcatgctcacagtgggctgcaacgtacaatgca

SEQ ID NO: 350 - DNA, 201 bp, Homo Sapien
gtgcccctctgttaagtatagtcttgcccttctgtatttgtgcaattaaaaaaaaatctaaattatagttcatcttgttggctttagattatcattctaarttttctaaatgtttttgaatcttaattttcatcatctagagttttaactactcctctaagattagaattacttgcaaattttctgatgaaaaaattgatc

SEQ ID NO: 351 - DNA, 201 bp, Homo Sapien
aacccataatggtttctagggttccccattgcccttcccaaatgttcacaaacatctatttcgtcatctgcttcagaaatttccagaaataaatgttgggrtcaagaacctttaaccattttttaaaaaggcaagatatctgtgcatctctaacccatatggacaaatggcaatgtttcttaatgaccttaggtctttaat

SEQ ID NO: 352 - DNA, 201 bp, Homo Sapien
cacataatcatttaaatagtcactaaatataggtgatcctacctcctcaatatctcatgaatctattacccctttaccatctctatagcaatgatctcagytgaatgcctcatcaccttttctatcaatgaaactcctccctaatttgtcttcctgtttctaactttggccccttcaattaattaatcctccacagcacta

SEQ ID NO: 353 - DNA, 201 bp, Homo Sapien
ctcaactctgttctcccctaggggctccctggtgttggcctcacaccttcagctgcccagactgcccgtcagcaccccaagatgcatcttgcccacagcamcctcaaacctgctgctcacctcattggtaaacatccacctgacctcccagacatgtccccaccagctctcctcctacccctgcctcaggaacccaagcat

SEQ ID NO: 354 - DNA, 201 bp, Homo Sapien
taggggtggtgtcttacctggcacctgcaggtgggcaaaggctttgaccttgccctggcggttagtggcggtgcagacgtaggtacctgcgtcctggggtyggactgagggcagcatcagcatgttgttctccaggcggctgtcaggtggcaggctgccatccagctgcaaatgcactagcactgagggccctggccttgg

SEQ ID NO: 355 - DNA, 201 bp, Homo Sapien; identical to SEQ ID NO: 197

SEQ ID NO: 356 - DNA, 201 bp, Homo Sapien
agatttatttgcatttctatttaagcagcatgtctcgctaaactttctttgaacttttctgcactaggtctgcactgacattgatgagtgtcgaaatggascgtgcgttcccaactcgatctgcgttaatactttggtaagtatttctcacagctgttgttatcaaagcagaaccggttattaaaacaagtgtatgtttat

SEQ ID NO: 357 - DNA, 201 bp, Homo Sapien
ggtgaggcttgatgaaaaagtaaagagaaatcgtaattgtatagttaaaaacataacttttgtcatcctcaaaattctaaaaattctttacctgtccttgrgaaatgggtgaaattgaaaaccatcaaaacaattggacttcttaaaaattggattgtatgagtgaaaggtgtttatgagaagtcgatgactccggatctt

SEQ ID NO: 358 - DNA, 201 bp, Homo Sapien
caagaggaaggagatcagagtttgcaaagcttttatgtggaccttggtgctgagatcttgcgatccttctccatggagctgcatcttcttgagatgtttayacagagaacagattagcatcagaaaagatatcagggacagagtaaagggtatgaagctccatagggtagttacagtcaaatatgaaagatgtactgtatt

SEQ ID NO: 359 - DNA, 201 bp, Homo Sapien; identical to SEQ ID NO: 279

SEQ ID NO: 360 - DNA, 201 bp, Homo Sapien; identical to SEQ ID NO: 280

SEQ ID NO: 361 - DNA, 201 bp, Homo Sapien
cgctgaattttatatagtctaggaaacattttcacattggttgtttcagtcaaatacaaagaagttacagaacagcatcgagtacctaagagagaccaaargcatttccttctgtaaagccctgcagctgagggcttacatccgcctggtccaatcagttcatttccaaacaaaggtaggaaatggctgcatcctagtatt

SEQ ID NO: 362 - DNA, 201 bp, Homo Sapien; identical to SEQ ID NO: 130

SEQ ID NO: 363 - DNA, 201 bp, Homo Sapien
gcaccgcaagatgggaagacaggtggcaactctcttacagggatatcttttatttgagcagaaccagaccaactgttcctcattaaaacacattttgcaaygtgttctcatgtgagcgcatcaagtgtgtgtgcatgtgtgtgttcagagcatactcagcgatgtgccatctacaggtcacaattacaaattcgcaacgtg

SEQ ID NO: 364 - DNA, 201 bp, Homo Sapien; identical to SEQ ID NO: 358

SEQ ID NO: 365 - DNA, 201 bp, Homo Sapien; identical to SEQ ID NO: 291

SEQ ID NO: 366 - DNA, 201 bp, Homo Sapien; identical to SEQ ID NO: 292

SEQ ID NO: 367 - DNA, 201 bp, Homo Sapien; identical to SEQ ID NO: 288

SEQ ID NO: 368 - DNA, 201 bp, Homo Sapien
ggagtcggggtcctcgtaccactgccagactgttcacccagttcaaagaaaaccctgcccgttgcaggctcatgccattctactacatccctttcatccarttctttgtgttctactgacttccccagcgcttcctttgggagaaggtgccaattcttcaatagttgattcctctctagaaatacaatgttcctgccaggt

SEQ ID NO: 369 - DNA, 201 bp, Homo Sapien; identical to SEQ ID NO: 286

SEQ ID NO: 370 - DNA, 201 bp, Homo Sapien; identical to SEQ ID NO: 287

SEQ ID NO: 371 - DNA, 201 bp, Homo Sapien
gctacctacattaacagctttgcagacagaaatgaggcccaggtgttctgtgctccatgaaagagtctactggacttccaagtcctggccctaccggaggsagctggactcaacacttcttttattagaagctccctttataagggattgttttgttgtaagtgacagaaatccaactcaaactagcttacaaaaagggaa

SEQ ID NO: 372 - DNA, 201 bp, Homo Sapien
atgtaactgcccagtgggctcttcctgtcctctgcacaaataaagaccacggcattgcagtaaagaaagagtttaattgacacgaggccggccatgccacwtgcaaaattgattattactcaagtcaatctccctgaaaattcagagatcagggtttttgataatttggtgggtagggggtcagaaagtggggagtgctaa

SEQ ID NO: 373 - DNA, 201 bp, Homo Sapien; identical to SEQ ID NO: 289

SEQ ID NO: 374 - DNA, 201 bp, Homo Sapien; identical to SEQ ID NO: 265

SEQ ID NO: 375 - DNA, 201 bp, Homo Sapien; identical to SEQ ID NO: 263

SEQ ID NO: 376 - DNA, 201 bp, Homo Sapien; identical to SEQ ID NO: 294

SEQ ID NO: 377 - DNA, 201 bp, Homo Sapien
cacccaaatcaaagtgaaactgaccagccagcctccggaggccctcgctgcatttgtgagggagggggaggtgggaagatgagggtttgaatttgggagcrgggagaaggaggggcatggtggaagggagtctgtgaagctcaaagatagttttgggggtccctcatgccctggccacgccagcagtgctgtgcacgccaa

SEQ ID NO: 378 - DNA, 201 bp, Homo Sapien; identical to SEQ ID NO: 297

SEQ ID NO: 379 - DNA, 201 bp, Homo Sapien
tcagaagcaaagtttcaggctcaccttttccttctctggaaaactcagctccttcccatcctggccagaccgggactcaggaagggctaagctagctgttyggcatctttccacccaaaagcatttagatatttgttcactgtgtgctgagaagagcccaagtgcaatgtgttggaaagaagcagggaggtgctgaggaca

SEQ ID NO: 380 - DNA, 201 bp, Homo Sapien; identical to SEQ ID NO: 303

SEQ ID NO: 381 - DNA, 201 bp, Homo Sapien; identical to SEQ ID NO: 304

SEQ ID NO: 382 - DNA, 201 bp, Homo Sapien; identical to SEQ ID NO: 356

SEQ ID NO: 383 - DNA, 201 bp, Homo Sapien
ttttcagaatctgattctctgcccctttctcctaatgaatctccatgttggtagaaatacatttataccttccctcctttaaaaatggaatatgacactasagacagacggcatcctagtcccagtcttccaagttcacatatgtaacacatctctgtattgtatattcatatgcattttcccatctctatacctaacaac

SEQ ID NO: 384 - DNA, 201 bp, Homo Sapien; identical to SEQ ID NO: 311

SEQ ID NO: 385 - DNA, 201 bp, Homo Sapien
taaaacccaagtccctcggccacatttgcactgaaatgtaaaataaagggttagacaggtacaatttcctttgtagtgataaaatcctctgattctattgyataatctccaaaagcaggtccaaaccgaataatttttttcccctgaaactagattcctccctgtttagtagagtccccatttccaatttaggactttgcc

SEQ ID NO: 386 - DNA, 201 bp, Homo Sapien
acaaaaaaaatacagtgagtaatggcaataatgttctcattaaaggaaaatacctcacaacttagacagaaacagagggaattagtgaaactccatccatygagggctcataggctgcccttggaaatactcttacctggtcacagtactagtgaattcatttcctggttaagttggtaaggtaggcatcttgaaagacat

SEQ ID NO: 387 - DNA, 201 bp, Homo Sapien
gtgttcaagtgacccttattttactgaacagtggctccaaagaacaaaagtagtgatgctggccatttgaacatgcctaggagaagctgggaagtgctttygttaagtgaaaaggtgagagctcttgacttaataacgaaagaataaaaattgcaatattaaagttgctgagatctacagtgagaatgaatttttttacct

SEQ ID NO: 388 - DNA, 201 bp, Homo Sapien
ctttgatgtattaaaatatattaatcgctcttaaagtatctcctcacatgatgcttattaattgcaaaaagaaaaacagttaactttacagaggggaaacytgacagccttccccataagcaaatgaccggtgtaaggtacagtggcatcatgtgcctctggatactatgcactgagaaggacataacaccactgtgagta

SEQ ID NO: 389 - DNA, 201 bp, Homo Sapien
gggtttgaatcccagctctgacctttactaactggataagtggggtgaattacttctctctctaagcttcaactcctccatctgtacatgggggtggggaycctcatacttcatgcaatctttgggagaattaagtgagttaatccacatagagcacggaaaccaggccttgacatgttgtgagccctctctgatgttagc

SEQ ID NO: 390 - DNA, 201 bp, Homo Sapien
tctctctaagcttcaactcctccatctgtacatgggggtggggatcctcatacttcatgcaatctttgggagaattaagtgagttaatccacatagagcayggaaaccaggccttgacatgttgtgagccctctctgatgttagctattgctattagagcaagttatttcccctttttgggatttcatactgttgtccagc

SEQ ID NO: 391 - DNA, 201 bp, Homo Sapien
agtgtaacctgaagtgatgtaagccaggcacagaaagacaaataccacatggtctcacttacatgtgaactctaaagagctgaattcatagaaacactgartaaaatagtggctaacaggctgaagggttggaggattggggagatgttggtcaaaggacacaaaatttcagttaggaggaagaagttcaaagatctattg

SEQ ID NO: 392 - DNA, 201 bp, Homo Sapien
tccaagcttagggaagccacttagctcccaggagcagatgagacccagtcctcctcctagcccaattgtaagcaaaaaaataatagcaaagtctttgctcrgggtcttttgggaccaaaccacttaaaaatagaataccccagagaacattttaatccttgtaattgaggtatttatcatctggaaatatagctgtttcta

SEQ ID NO: 393 - DNA, 201 bp, Homo Sapien
agctcaacttgaaatacacttccctgaaaggattactttgttttgggacaaggctcatatcaatctgtcctgccaagagattactgctgttaaactgttgkttttcactgctgtcaaacataatcttacaaggagagagaggggcaatcaccctcaacacccagctgcaagagaagacttttgactgggcaggacttttcc

SEQ ID NO: 394 - DNA, 201 bp, Homo Sapien
agggtttggcctaacacacaaaggatgggaagaataaagaaacgatgttccaacagtatttctgcagatctaagctactgaagggatgctggaccaaccaygatagatgcttccttttccgcagtgcctcgaaaaacacttaggagtgtgaaggagtgaaattttatgctattggccttgttctcatttacttttgattat

SEQ ID NO: 395 - DNA, 201 bp, Homo Sapien
ccctctctgggactcagtttcctactctgtacaattgggacggtgacctactttcaaggacctttatagttcaaacgctcttcggttctgtgaaaagaagycttacatcatcccatggtgggctgcatgtcacattatcacacagagtggtccttgctttacagaaaaatattcatttgctcattcattcacctatccact

SEQ ID NO: 396 - DNA, 201 bp, Homo Sapien; identical to SEQ ID NO: 336

SEQ ID NO: 397 - DNA, 201 bp, Homo Sapien
ttctcatttacttttgattattataaaattattctaacgcaaaacccataaaaaattggtaactcagaatctcgccagatgaactgttacatcggactacrctctaggaagaagtattaaaaatcaaagatattaactttccaagtgttcatttccatctgttttccctctctgggactcagtttcctactctgtacaatt

SEQ ID NO: 398 - DNA, 201 bp, Homo Sapien
ccaagtgttcatttccatctgttttccctctctgggactcagtttcctactctgtacaattgggacggtgacctactttcaaggacctttatagttcaaaygctcttcggttctgtgaaaagaagccttacatcatcccatggtgggctgcatgtcacattatcacacagagtggtccttgctttacagaaaaatattcat

SEQ ID NO: 399 - DNA, 201 bp, Homo Sapien
cagccccccaggtgtgttccagcaagctctattccactagggaagaaatgagtcatcgtatgtgttgatacaggctgaaggccgccacaaacacatacctkcaggagcttctaatctcatcaggaacatgttgagagtctgacggcctgttataacggcgaaccaccctgttccaagcagcgggacttgctctgctttctc

SEQ ID NO: 400 - DNA, 201 bp, Homo Sapien
tcttagcactccccccacccctgctccgaaacttgattcaatcagtggtggatgggaaaggcccgtttccatgacaaccccactgtgagagagaaaaatcrgccacagagcaggctagaattttatctggaagagggcacttgggtaggtttagaaatggaggcccagcaaacagtgcgatgggctcgcatcccatggtgg

SEQ ID NO: 401 - DNA, 201 bp, Homo Sapien; identical to SEQ ID NO: 385

SEQ ID NO: 402 - DNA, 201 bp, Homo Sapien; identical to SEQ ID NO: 386

SEQ ID NO: 403 - DNA, 201 bp, Homo Sapien; identical to SEQ ID NO: 387

SEQ ID NO: 404 - DNA, 201 bp, Homo Sapien; identical to SEQ ID NO: 388

SEQ ID NO: 405 - DNA, 201 bp, Homo Sapien
tttatatttttccttcaaggtttgggagttagtagctttatagataagggcagtcttgatcataaacctgactacatttgcacaaaatggtggagttagtytatcccttccctgctttaaatcctagtgcttactaataaatgtcctttgtggcctgccctgcaacctccctccactaaatggtgcacttttgtctgcatt

SEQ ID NO: 406 - DNA, 201 bp, Homo Sapien
aacctcatctcaagactctgtggccaggccctcacaacctcctgccaggctctcgctacctacccatcaacagcaagactcccaggccatctcaatccccscaaagagccctgttcctccagccccacggcttctgttcacctgccgtgctgtccccgcctctgcccacccactcatcctgcagatctggagcagcattcc

SEQ ID NO: 407 - DNA, 201 bp, Homo Sapien; identical to SEQ ID NO: 290

SEQ ID NO: 408 - DNA, 201 bp, Homo Sapien
ggttgagggctcagtcccacaagactgcccctcactttggatgccaactgcaagcctcaggttgtttttacctgtactcatgactaactgggtgtaagctrgggttcctacgattccctctttatgttcaatgaatttgctagagtggctgacagaactcaggaaaaaatgtttactggtttattataaaggatttttttt

SEQ ID NO: 409 - DNA, 201 bp, Homo Sapien
agcagcagggtagaaaaggcagccataactgcaaggcaggcagaagatgtagcagagtagacaggaagcagtccaactgacagagaatactggaagatatkagaacaactaagggacacaaaataaaatgacaaacacttggatgcaagagtgatgccagggccaaggaaaattaaacatggccaagatggccacaaaaca

SEQ ID NO: 410 - DNA, 201 bp, Homo Sapien
ccctgtggagtcaaaggttaaaactcacaggtgacagggccagcacactaaaccccacttgcttctcctctttccaccacctcagccctgtgaccagcatracttacaggttccagcactgcaggctctctcttctctcccttcagcccccggggcccatgggcagcctaagggagacacacatgtaaccccagtggggcc

What is claimed is:

1. A method of determining whether a human has an increased genetic risk for myocardial infarction (MI), comprising:
testing nucleic acids from said human for the presence of a polymorphism in gene KIF6 at position 101 of SEQ ID NO: 263 or its complement, and
detecting the presence of G at position 101 of SEQ ID NO: 263 or C at position 101 of its complement, which indicates said human has said increased genetic risk for MI relative to a human who is homozygous for an A at position 101 of SEQ ID NO 263 or homozygous for a T at position 101 of its complement.

2. The method of claim 1, wherein said nucleic acid is a nucleic acid extract from a biological sample from said human.

3. The method of claim 2, wherein said biological sample is blood, saliva, or buccal cells.

4. The method of claim 2, further comprising preparing said nucleic acid extract from said biological sample prior to said testing.

5. The method of claim 4, further comprising obtaining said biological sample from said human prior to said preparing.

6. The method of claim 1, wherein said testing comprises nucleic acid amplification.

7. The method of claim 6, wherein said nucleic acid amplification is carried out by polymerase chain reaction.

8. The method of claim 1, further comprising correlating the presence of said G or said C with a reduction of likelihood of developing MI in said human following treatment with an HMG-CoA reductase inhibitor.

9. The method of claim 8, wherein said correlating is performed by computer software.

10. The method of claim 8, wherein said HMG-CoA reductase inhibitor is a hydrophilic statin.

11. The method of claim 8, wherein said HMG-CoA reductase inhibitor is a hydrophobic statin.

12. The method of claim 8, wherein said HMG-CoA reductase inhibitor is selected from the group consisting of pravastatin, atorvastatin, simvastatin, cerevastatin and lovastatin, or a any combination thereof.

13. The method of any one of claims 1 to 7 and 8 to 12, wherein said testing is performed using sequencing, 5' nuclease digestion, molecular beacon assay, oligonucleotide ligation assay, size analysis, single-stranded conformation polymorphism analysis, or denaturing gradient gel electrophoresis (DGGE).

14. The method of any one of claims 1 to 7 and 8 to 12, wherein said testing is performed using an allele-specific method.

15. The method of claim 14, wherein said allele-specific method is allele-specific probe hybridization, allele-specific primer extension, or allele-specific amplification.

16. The method of claim 14, wherein said allele-specific method detects said G or said C.

17. The method of any one of claims 1 to 4, 6, 7, and 8 to 9 which is an automated method.

18. A method of determining whether a human has an increased genetic risk for myocardial infarction (MI), comprising:
a) testing nucleic acids from said human for the presence of a polymorphism in gene KIF6 at position 101 of SEQ ID NO: 263 or its complement; and
b) correlating the presence of G at position 101 of SEQ ID NO: 263 or C at position 101 or its complement with said human having said increased genetic risk for MI relative to a human who is homozygous for an A at position 101 of SEQ ID NO 263 or homozygous for a T at position 101 of its complement.

19. The method of claim 18, wherein said correlating is performed by computer software.

20. The method of claim 18, wherein said nucleic acid is a nucleic acid extract from a biological sample from said human.

21. The method of claim 20, wherein said biological sample is blood, saliva, or buccal cells.

22. The method of claim 20, further comprising preparing said nucleic acid extract from said biological sample prior to said testing.

23. The method of claim 22, further comprising obtaining said biological sample from said human prior to said preparing.

24. The method of claim 18, wherein said testing comprises nucleic acid amplification.

25. The method of claim 24, wherein said nucleic acid amplification is carried out by polymerase chain reaction.

26. The method of claim 18, further comprising correlating the presence of said G or said C with a reduction of likelihood of developing MI in said human following treatment with an HMG-CoA reductase inhibitor.

27. The method of claim 26, wherein said correlating is performed by computer software.

28. The method of claim 26, wherein said HMG-CoA reductase inhibitor is a hydrophilic statin.

29. The method of claim 26, wherein said HMG-CoA reductase inhibitor is a hydrophobic statin.

30. The method of claim 26, wherein said HMG-CoA reductase inhibitor is selected from the group consisting of pravastatin, atorvastatin, simvastatin, cerevastatin and lovastatin, or any combination thereof.

31. The method of any one of claims 18 to 30, wherein said testing is performed using sequencing, 5' nuclease digestion, molecular beacon assay, oligonucleotide ligation assay, size analysis, single-stranded conformation polymorphism analysis, or denaturing gradient gel electrophoresis (DGGE).

32. The method of any one of claims 18 to 30, wherein said testing is performed using an allele-specific method.

33. The method of claim 32, wherein said allele-specific method is allele-specific probe hybridization, allele-specific primer extension, or allele-specific amplification.

34. The method of claim 32, wherein said allele-specific method detects said G or said C.

35. The method of any one of claims 18 to 22 and 24 to 27 which is an automated method.

36. The method of any one of claims 1, 8, 18, and 26 wherein said human did not have MI prior to said testing.

37. The method of any one of claims 1, 8, 18, and 26 wherein said human had MI prior to said testing.

38. The method of any one of claims 1, 8, 18, and 26 wherein said human is homozygous for said G or said C.

39. The method of any one of claims 1, 8, 18, and 26 wherein said human is heterozygous for said G or said C.

* * * * *